US010369209B2

(12) United States Patent
Lee

(10) Patent No.: US 10,369,209 B2
(45) Date of Patent: Aug. 6, 2019

(54) DRUG TARGET AND CONSTRUCT FOR JAPANESE ENCEPHALITIS VIRUS INFECTION

(71) Applicant: Young-Min Lee, North Logan, UT (US)

(72) Inventor: Young-Min Lee, North Logan, UT (US)

(73) Assignee: Utah State University, Cache County, Logan, UT (US)

( * ) Notice: Subject to any disclaimer, the term of this patent is extended or adjusted under 35 U.S.C. 154(b) by 0 days.

(21) Appl. No.: 15/303,375

(22) PCT Filed: Apr. 10, 2015

(86) PCT No.: PCT/US2015/025471
§ 371 (c)(1),
(2) Date: Oct. 11, 2016

(87) PCT Pub. No.: WO2015/157730
PCT Pub. Date: Oct. 15, 2015

(65) Prior Publication Data
US 2017/0196963 A1     Jul. 13, 2017

Related U.S. Application Data

(60) Provisional application No. 61/978,285, filed on Apr. 11, 2014.

(51) Int. Cl.
*A61K 39/12*        (2006.01)
*C07K 14/005*       (2006.01)
(Continued)

(52) U.S. Cl.
CPC ............ *A61K 39/12* (2013.01); *C07K 14/005* (2013.01); *C12N 7/00* (2013.01); *C12Q 1/18* (2013.01);
(Continued)

(58) Field of Classification Search
None
See application file for complete search history.

(56) References Cited

U.S. PATENT DOCUMENTS 5,736,148 A * 4/1998 Sumiyoshi ........... C07K 14/005
                                                424/218.1
7,811,579 B2  10/2010 Lee et al.
(Continued)

FOREIGN PATENT DOCUMENTS

CN         103205460 A     7/2013

OTHER PUBLICATIONS

GenBank: JN604986.1 Japanese encephalitis virus strain SA14-14-2, complete genome (Year: 2012).*
(Continued)

*Primary Examiner* — Michelle S Horning

(57) ABSTRACT

A group of mosquito-borne flaviviruses that cause fatal encephalitis in humans is among the most important of all emerging human pathogens of global significance. This group includes Japanese encephalitis virus (JEV), West Nile virus, St. Louis encephalitis virus, and Murray Valley encephalitis virus. In the present disclosure, the first reverse genetics system has been developed for SA14-14-2, a live JE vaccine that is most commonly used in most JE-endemic areas, by constructing an infectious bacterial artificial chromosome that contains the full-length SA14-14-2 cDNA. Using this infectious SA 14-14-2 cDNA, combined with a mouse model for JEV infection, a key viral neurovirulence factor has been discovered that is a conserved single amino acid in the ij hairpin adjacent to the fusion loop of the viral E glycoprotein, which regulates viral infectivity into neurons within the central nervous system.

5 Claims, 22 Drawing Sheets
Specification includes a Sequence Listing.

(51) Int. Cl.
*C12N 7/00* (2006.01)
*C12Q 1/18* (2006.01)
*G01N 33/50* (2006.01)
*A61K 39/00* (2006.01)

(52) U.S. Cl.
CPC ...... *G01N 33/502* (2013.01); *A61K 2039/525* (2013.01); *C12N 2770/24111* (2013.01); *C12N 2770/24122* (2013.01); *C12N 2770/24134* (2013.01); *C12N 2770/24143* (2013.01); *C12N 2770/24152* (2013.01); *G01N 2333/18* (2013.01); *G01N 2333/185* (2013.01); *G01N 2800/26* (2013.01)

(56) References Cited

U.S. PATENT DOCUMENTS

2007/0087982 A1 4/2007 Nelson et al.
2010/0184832 A1 7/2010 Pugachev et al.

OTHER PUBLICATIONS

Blast alignment for SEQ ID No. 4 including GenBank: JN604986.1 (2012) (Year: 2012).*
International Search Report and Written Opinion for PCT/US2015/025471 filed on Apr. 10, 2015.
Perez-Vargas et al., Structural Basis of Eukaryotic Cell—Cell fusion, 157:2 Cell 407-419/S1-S11 (Apr. 10, 2014).
Lee et al., Profiling of Viral Proteins Expressed from the Genomic RNA of Japanese Encephalitis Virus Using a Panel of 15 Region-Specific Polyclonal Rabbit Antisera: Implications for Viral Gene Expression, 10:4 PLoS ONE 1-27 (Apr. 27, 2015).
Lee et al., A Molecularly Cloned, Live-Attenuated Japanese Encephalitis Vaccine SA14-14-2 Virus: A Conserved Single Amino Acid in the ij Hairpin of the Viral E Glycoprotein Determines Neurovirulence in Mice, 10:7 PLoS Pathogens 1-16 (Jul. 31, 2014).
Lee et al., Japanese encephalitis: The virus and vaccines, 10:2 Human Vaccines and Immunotherapeutics 263-279 (Feb. 2014).
Lee et al., Bacterial Artificial Chromosomes: A functional Genomics Tool for the Study of Positive-strand RNA Viruses, 106 Journal of Visualized Experiments 1-14 (Dec. 2015).

* cited by examiner

Table 2. *In vivo* attenuation phenotypes of $SA_{14-14-2}^{MCV}$ in mice.

| Route | $SA_{14-14-2}^{MCV}$ | | | $SA_{14-14-2}$ | | | ONU/LP2 (virulent strain) | | |
|---|---|---|---|---|---|---|---|---|---|
| | IC | IM | IP | IC | IM | IP | IC | IM | IP |
| $LD_{50}$ | >1.5×10⁵ | >1.5×10⁵ | >1.5×10⁵ | >1.5×10⁵ | >1.5×10⁵ | >1.5×10⁵ | <1.5 | <1.5 | <1.5 |

FIG. 16

Table 3. Summary of the virological properties of three $SA_{14}$-14-$2^{MCV}$ variants in mice.

| | $SA_{14}$-14-$2^{MCV}$ | | | $SA_{14}$-14-$2^{MCV}$/V1 | | | $SA_{14}$-14-$2^{MCV}$/V2 | | | $SA_{14}$-14-$2^{MCV}$/V3 | | |
|---|---|---|---|---|---|---|---|---|---|---|---|---|
| Route | IC | IM | IP | IC | IM | IP | IC | IM | IP | IC | IM | IP |
| $LD_{50}$ | $>1.5 \times 10^5$ | $>1.5 \times 10^5$ | $>1.5 \times 10^5$ | $<1.5$ | $>1.5 \times 10^5$ | $>1.5 \times 10^5$ | $<1.5$ | $>1.5 \times 10^5$ | $>1.5 \times 10^5$ | $<1.5$ | $>1.5 \times 10^5$ | $>1.5 \times 10^5$ |

FIG. 17

Table 4. Neurovirulence and neuroinvasiveness of SA$_{14}$-14-2$^{MCV}$ and its three variants in 3-week-old ICR mice.

| Virus | Inoculum (PFU/mouse) | IC Alive | IC Dead | IC Total | IC LD$_{50}$(PFU) | IM Alive | IM Dead | IM Total | IM LD$_{50}$(PFU) | IP Alive | IP Dead | IP Total | IP LD$_{50}$(PFU) |
|---|---|---|---|---|---|---|---|---|---|---|---|---|---|
| SA$_{14}$-14-2$^{MCV}$ | 1.5 x 10$^5$ | 7 | 3 | 10 | >1.5 x 10$^5$ | 10 | 0 | 10 | >1.5 x 10$^5$ | 10 | 0 | 10 | >1.5 x 10$^5$ |
| | 1.5 x 10$^4$ | 9 | 1 | 10 | | 10 | 0 | 10 | | 10 | 0 | 10 | |
| | 1.5 x 10$^3$ | 10 | 0 | 10 | | 10 | 0 | 10 | | 10 | 0 | 10 | |
| | 1.5 x 10$^2$ | 10 | 0 | 10 | | 10 | 0 | 10 | | 10 | 0 | 10 | |
| | 1.5 x 10$^1$ | 10 | 0 | 10 | | 10 | 0 | 10 | | 10 | 0 | 10 | |
| | 1.5 | 10 | 0 | 10 | | 10 | 0 | 10 | | 10 | 0 | 10 | |
| SA$_{14}$-14-2$^{MCV}$/V1 | 1.5 x 10$^5$ | 0 | 10 | 10 | <1.5 | 10 | 0 | 10 | >1.5 x 10$^5$ | 10 | 0 | 10 | >1.5 x 10$^5$ |
| | 1.5 x 10$^4$ | 0 | 10 | 10 | | 10 | 0 | 10 | | 10 | 0 | 10 | |
| | 1.5 x 10$^3$ | 0 | 10 | 10 | | 10 | 0 | 10 | | 10 | 0 | 10 | |
| | 1.5 x 10$^2$ | 0 | 10 | 10 | | 10 | 0 | 10 | | 10 | 0 | 10 | |
| | 1.5 x 10$^1$ | 0 | 10 | 10 | | 10 | 0 | 10 | | 10 | 0 | 10 | |
| | 1.5 | 2 | 8 | 10 | | 10 | 0 | 10 | | 10 | 0 | 10 | |
| SA$_{14}$-14-2$^{MCV}$/V2 | 1.5 x 10$^5$ | 0 | 10 | 10 | <1.5 | 10 | 0 | 10 | >1.5 x 10$^5$ | 10 | 0 | 10 | >1.5 x 10$^5$ |
| | 1.5 x 10$^4$ | 0 | 10 | 10 | | 10 | 0 | 10 | | 10 | 0 | 10 | |
| | 1.5 x 10$^3$ | 0 | 10 | 10 | | 10 | 0 | 10 | | 10 | 0 | 10 | |
| | 1.5 x 10$^2$ | 0 | 10 | 10 | | 10 | 0 | 10 | | 10 | 0 | 10 | |
| | 1.5 x 10$^1$ | 0 | 10 | 10 | | 10 | 0 | 10 | | 10 | 0 | 10 | |
| | 1.5 | 0 | 10 | 10 | | 10 | 0 | 10 | | 10 | 0 | 10 | |
| SA$_{14}$-14-2$^{MCV}$/V3 | 1.5 x 10$^5$ | 0 | 10 | 10 | <1.5 | 10 | 0 | 10 | >1.5 x 10$^5$ | 10 | 0 | 10 | >1.5 x 10$^5$ |
| | 1.5 x 10$^4$ | 0 | 10 | 10 | | 10 | 0 | 10 | | 10 | 0 | 10 | |
| | 1.5 x 10$^3$ | 0 | 10 | 10 | | 10 | 0 | 10 | | 10 | 0 | 10 | |
| | 1.5 x 10$^2$ | 0 | 10 | 10 | | 10 | 0 | 10 | | 10 | 0 | 10 | |
| | 1.5 x 10$^1$ | 1 | 9 | 10 | | 10 | 0 | 10 | | 10 | 0 | 10 | |
| | 1.5 | 3 | 7 | 10 | | 10 | 0 | 10 | | 10 | 0 | 10 | |

FIG. 18

Table 5. Comparison of the complete genome sequence of the $SA_{14}$-14-2$^{MCV}$ parental virus and its three variant viruses.

| $SA_{14}$-14-2$^{MCV}$–derived variant | Nucleotide substitution (Amino acid substitution) | | | | | | |
|---|---|---|---|---|---|---|---|
| $SA_{14}$-14-2$^{MCV}$/V1 | | | $G^{1708}A$ (Gly$^{244}$→Glu) | $U^{2380}C$ (silent) | | | |
| $SA_{14}$-14-2$^{MCV}$/V2 | $G^{317}A$ (silent) | | $G^{1708}A$ (Gly$^{244}$→Glu) | | | | |
| $SA_{14}$-14-2$^{MCV}$/V3 | | $U^{419}C$ (silent) | $G^{1708}A$ (Gly$^{244}$→Glu) | | $C^{3215}U$ (silent) | $C^{5367}U$ (silent) | $G^{6651}A$ (silent) | $U^{8588}C$ (silent) |
| Location | C | | E | | NS1 | NS3 | NS4A | NS5 |

FIG. 19

Table 7. Neurovirulence of SA$_{14}$-2$^{MCV}$ and its eight mutants in 3-week-old ICR mice.

| Virus | Inoculum (PFU/mouse) | IC Alive | IC Dead | IC Total | LD$_{50}$ (PFU) | Virus | Inoculum (PFU/mouse) | IC Alive | IC Dead | IC Total | LD$_{50}$ (PFU) |
|---|---|---|---|---|---|---|---|---|---|---|---|
| SA$_{14}$-2$^{MCV}$ (WT) | 1.5 x 10$^5$ | 7 | 3 | 10 | >1.5 x 10$^5$ | C$^{3239}$U | 1.5 x 10$^5$ | 9 | 1 | 10 | >1.5 x 10$^5$ |
|  | 1.5 x 10$^4$ | 8 | 2 | 10 |  |  | 1.5 x 10$^4$ | 10 | 0 | 10 |  |
|  | 1.5 x 10$^3$ | 10 | 0 | 10 |  |  | 1.5 x 10$^3$ | 10 | 0 | 10 |  |
|  | 1.5 x 10$^2$ | 10 | 0 | 10 |  |  | 1.5 x 10$^2$ | 10 | 0 | 10 |  |
|  | 1.5 x 10$^1$ | 10 | 0 | 10 |  |  | 1.5 x 10$^1$ | 10 | 0 | 10 |  |
|  | 1.5 | 10 | 0 | 10 |  |  | 1.5 | 10 | 0 | 10 |  |
| G$^{317}$A | 1.5 x 10$^5$ | 8 | 2 | 10 | >1.5 x 10$^5$ | C$^{3387}$U | 1.5 x 10$^5$ | 10 | 0 | 10 | >1.5 x 10$^5$ |
|  | 1.5 x 10$^4$ | 9 | 1 | 10 |  |  | 1.5 x 10$^4$ | 10 | 0 | 10 |  |
|  | 1.5 x 10$^3$ | 9 | 1 | 10 |  |  | 1.5 x 10$^3$ | 10 | 0 | 10 |  |
|  | 1.5 x 10$^2$ | 10 | 0 | 10 |  |  | 1.5 x 10$^2$ | 10 | 0 | 10 |  |
|  | 1.5 x 10$^1$ | 10 | 0 | 10 |  |  | 1.5 x 10$^1$ | 10 | 0 | 10 |  |
|  | 1.5 | 10 | 0 | 10 |  |  | 1.5 | 10 | 0 | 10 |  |
| U$^{449}$C | 1.5 x 10$^5$ | 8 | 2 | 10 | >1.5 x 10$^5$ | G$^{6651}$A | 1.5 x 10$^5$ | 10 | 0 | 10 | >1.5 x 10$^5$ |
|  | 1.5 x 10$^4$ | 9 | 1 | 10 |  |  | 1.5 x 10$^4$ | 10 | 0 | 10 |  |
|  | 1.5 x 10$^3$ | 10 | 0 | 10 |  |  | 1.5 x 10$^3$ | 10 | 0 | 10 |  |
|  | 1.5 x 10$^2$ | 10 | 0 | 10 |  |  | 1.5 x 10$^2$ | 10 | 0 | 10 |  |
|  | 1.5 x 10$^1$ | 10 | 0 | 10 |  |  | 1.5 x 10$^1$ | 10 | 0 | 10 |  |
|  | 1.5 | 10 | 0 | 10 |  |  | 1.5 | 10 | 0 | 10 |  |
| G$^{7208}$A | 1.5 x 10$^5$ | 0 | 10 | 10 | <1.5 | U$^{8558}$C | 1.5 x 10$^5$ | 10 | 0 | 10 | >1.5 x 10$^5$ |
|  | 1.5 x 10$^4$ | 0 | 10 | 10 |  |  | 1.5 x 10$^4$ | 9 | 1 | 10 |  |
|  | 1.5 x 10$^3$ | 0 | 10 | 10 |  |  | 1.5 x 10$^3$ | 10 | 0 | 10 |  |
|  | 1.5 x 10$^2$ | 0 | 10 | 10 |  |  | 1.5 x 10$^2$ | 10 | 0 | 10 |  |
|  | 1.5 x 10$^1$ | 0 | 10 | 10 |  |  | 1.5 x 10$^1$ | 10 | 0 | 10 |  |
|  | 1.5 | 0 | 10 | 10 |  |  | 1.5 | 10 | 0 | 10 |  |
| U$^{2890}$C | 1.5 x 10$^5$ | 8 | 2 | 10 | >1.5 x 10$^5$ |  |  |  |  |  |  |
|  | 1.5 x 10$^4$ | 10 | 0 | 10 |  |  |  |  |  |  |  |
|  | 1.5 x 10$^3$ | 10 | 0 | 10 |  |  |  |  |  |  |  |
|  | 1.5 x 10$^2$ | 10 | 0 | 10 |  |  |  |  |  |  |  |
|  | 1.5 x 10$^1$ | 10 | 0 | 10 |  |  |  |  |  |  |  |
|  | 1.5 | 10 | 0 | 10 |  |  |  |  |  |  |  |

FIG. 20

Table 9. Neurovirulence of SA$_{14}$-14-2$^{MCV}$ and its 14 E-244 mutants in 3-week-old ICR mice.

| Virus | Inoculum (PFU/mouse) | IC Alive | Dead | Total | LD$_{50}$(PFU) | Virus | Inoculum (PFU/mouse) | IC Alive | Dead | Total | LD$_{50}$(PFU) | Virus | Inoculum (PFU/mouse) | IC Alive | Dead | Total | LD$_{50}$(PFU) |
|---|---|---|---|---|---|---|---|---|---|---|---|---|---|---|---|---|---|
| SA$_{14}$-14-2$^{MCV}$ (WT) | 1.5 × 10$^5$ | 8 | 2 | 10 | >1.5 × 10$^5$ | G$^{244}$F | 1.5 × 10$^5$ | 10 | 0 | 10 | >1.5 × 10$^4$ | G$^{244}$Q | 1.5 × 10$^5$ | 10 | 0 | 10 | 1.5 |
|  | 1.5 × 10$^4$ | 10 | 0 | 10 |  |  | 1.5 × 10$^4$ | 10 | 0 | 10 |  |  | 1.5 × 10$^4$ | 1 | 9 | 10 |  |
|  | 1.5 × 10$^3$ | 10 | 0 | 10 |  |  | 1.5 × 10$^3$ | 10 | 0 | 10 |  |  | 1.5 × 10$^3$ | 2 | 8 | 10 |  |
|  | 1.5 × 10$^2$ | 10 | 0 | 10 |  |  | 1.5 × 10$^2$ | 10 | 0 | 10 |  |  | 1.5 × 10$^2$ | 1 | 9 | 10 |  |
|  | 1.5 × 10$^1$ | 10 | 0 | 10 |  |  | 1.5 × 10$^1$ | 10 | 0 | 10 |  |  | 1.5 × 10$^1$ | 2 | 8 | 10 |  |
|  | 1.5 | 10 | 0 | 10 |  |  | 1.5 | 10 | 0 | 10 |  |  | 1.5 | 2 | 8 | 10 |  |
| G$^{244}$E | 1.5 × 10$^5$ | 0 | 10 | 10 | <1.5 | G$^{244}$W | 1.5 × 10$^5$ | 10 | 0 | 10 | >1.5 × 10$^4$ | G$^{244}$L | 1.5 × 10$^5$ | 0 | 10 | 10 | >1.5 × 10$^5$ |
|  | 1.5 × 10$^4$ | 0 | 10 | 10 |  |  | 1.5 × 10$^4$ | 10 | 0 | 10 |  |  | 1.5 × 10$^4$ | 10 | 0 | 10 |  |
|  | 1.5 × 10$^3$ | 0 | 10 | 10 |  |  | 1.5 × 10$^3$ | 10 | 0 | 10 |  |  | 1.5 × 10$^3$ | 10 | 0 | 10 |  |
|  | 1.5 × 10$^2$ | 0 | 10 | 10 |  |  | 1.5 × 10$^2$ | 10 | 0 | 10 |  |  | 1.5 × 10$^2$ | 10 | 0 | 10 |  |
|  | 1.5 × 10$^1$ | 0 | 10 | 10 |  |  | 1.5 × 10$^1$ | 10 | 0 | 10 |  |  | 1.5 × 10$^1$ | 10 | 0 | 10 |  |
|  | 1.5 | 10 | 0 | 10 |  |  | 1.5 | 10 | 0 | 10 |  |  | 1.5 | 10 | 0 | 10 |  |
| G$^{244}$D | 1.5 × 10$^5$ | 0 | 10 | 10 | 1.5 | G$^{244}$T | 1.5 × 10$^5$ | 0 | 10 | 10 | <1.5 | G$^{244}$P | 1.5 × 10$^5$ | 0 | 10 | 10 | <1.5 |
|  | 1.5 × 10$^4$ | 0 | 10 | 10 |  |  | 1.5 × 10$^4$ | 0 | 10 | 10 |  |  | 1.5 × 10$^4$ | 0 | 10 | 10 |  |
|  | 1.5 × 10$^3$ | 0 | 10 | 10 |  |  | 1.5 × 10$^3$ | 0 | 10 | 10 |  |  | 1.5 × 10$^3$ | 0 | 10 | 10 |  |
|  | 1.5 × 10$^2$ | 0 | 10 | 10 |  |  | 1.5 × 10$^2$ | 0 | 10 | 10 |  |  | 1.5 × 10$^2$ | 0 | 10 | 10 |  |
|  | 1.5 × 10$^1$ | 2 | 8 | 10 |  |  | 1.5 × 10$^1$ | 2 | 8 | 10 |  |  | 1.5 × 10$^1$ | 0 | 10 | 10 |  |
|  | 1.5 | 3 | 7 | 10 |  |  | 1.5 | 3 | 7 | 10 |  |  | 1.5 | 0 | 10 | 10 |  |
| G$^{244}$R | 1.5 × 10$^5$ | N.D. |  |  | >1.5 × 10$^4$ | G$^{244}$S | 1.5 × 10$^5$ | 0 | 10 | 10 | 3.1 × 10$^1$ | G$^{244}$A | 1.5 × 10$^5$ | 1 | 9 | 10 | 5.8 × 10$^3$ |
|  | 1.5 × 10$^4$ | 10 | 0 | 10 |  |  | 1.5 × 10$^4$ | 1 | 9 | 10 |  |  | 1.5 × 10$^4$ | 4 | 6 | 10 |  |
|  | 1.5 × 10$^3$ | 10 | 0 | 10 |  |  | 1.5 × 10$^3$ | 1 | 9 | 10 |  |  | 1.5 × 10$^3$ | 6 | 4 | 10 |  |
|  | 1.5 × 10$^2$ | 10 | 0 | 10 |  |  | 1.5 × 10$^2$ | 3 | 7 | 10 |  |  | 1.5 × 10$^2$ | 8 | 2 | 10 |  |
|  | 1.5 × 10$^1$ | 10 | 0 | 10 |  |  | 1.5 × 10$^1$ | 5 | 5 | 10 |  |  | 1.5 × 10$^1$ | 10 | 0 | 10 |  |
|  | 1.5 | 10 | 0 | 10 |  |  | 1.5 | 9 | 1 | 10 |  |  | 1.5 | 10 | 0 | 10 |  |
| G$^{244}$K | 1.5 × 10$^5$ | N.D. |  |  | >1.5 × 10$^4$ | G$^{244}$N | 1.5 × 10$^5$ | 6 | 4 | 10 | >1.5 × 10$^5$ | G$^{244}$V | 1.5 × 10$^5$ | 0 | 10 | 10 | 1.2 × 10$^3$ |
|  | 1.5 × 10$^4$ | 7 | 3 | 10 |  |  | 1.5 × 10$^4$ | 9 | 1 | 10 |  |  | 1.5 × 10$^4$ | 3 | 7 | 10 |  |
|  | 1.5 × 10$^3$ | 9 | 1 | 10 |  |  | 1.5 × 10$^3$ | 10 | 0 | 10 |  |  | 1.5 × 10$^3$ | 3 | 7 | 10 |  |
|  | 1.5 × 10$^2$ | 10 | 0 | 10 |  |  | 1.5 × 10$^2$ | 10 | 0 | 10 |  |  | 1.5 × 10$^2$ | 4 | 6 | 10 |  |
|  | 1.5 × 10$^1$ | 10 | 0 | 10 |  |  | 1.5 × 10$^1$ | 10 | 0 | 10 |  |  | 1.5 × 10$^1$ | 8 | 2 | 10 |  |
|  | 1.5 | 10 | 0 | 10 |  |  | 1.5 | 10 | 0 | 10 |  |  | 1.5 | 9 | 1 | 10 |  |

N.D., Not determined.

FIG. 21

Table 10. Genetic stability of 14 E-244 mutants recovered from mouse brains after IC inoculation.

| | Input virus | | Recovered virus | |
|---|---|---|---|---|
| Virus | Initial codon | (amino acid) | Nucleotide change (amino acid change) | No. of independent clones |
| ☐ SA₁₄-14-2ᴹᵁᵀ (WT) | GGG | (Gly) | | |
| ■ G²⁴⁴E | GAG | (Glu) | None | 28/28 |
| ■ G²⁴⁴D | GAC | (Asp) | None | 30/30 |
| ☐ G²⁴⁴R | AGA | (Arg) | N.A. | |
| ☐ G²⁴⁴K | AAG | (Lys) | None | 1/30 |
| | | | AAG→GAG (Lys→Glu) | 25/30 |
| | | | AAG→ACG (Lys→Thr) | 4/30 |
| ☐ G²⁴⁴F | UUC | (Phe) | N.A. | |
| ☐ G²⁴⁴W | UGG | (Trp) | N.A. | |
| ■ G²⁴⁴T | ACG | (Thr) | None | 30/30 |
| ■ G²⁴⁴S | AGC | (Ser) | None | 30/30 |
| ☐ G²⁴⁴N | AAC | (Asn) | None | 8/30 |
| | | | AAC→GAC (Asn→Asp) | 22/30 |
| ■ G²⁴⁴Q | CAG | (Gln) | None | 30/30 |
| ☐ G²⁴⁴L | CUG | (Leu) | N.A. | |
| ■ G²⁴⁴P | CCG | (Pro) | None | 28/28 |
| ▨ G²⁴⁴A | GCC | (Ala) | None | 30/30 |
| ▨ G²⁴⁴V | GUC | (Val) | None | 30/30 |

☐ Attenuated ▨ Intermediate ■ Neurovirulent
N.A. Not available.

DRUG TARGET AND CONSTRUCT FOR JAPANESE ENCEPHALITIS VIRUS INFECTION

CROSS-REFERENCE TO RELATED APPLICATIONS

This is a U.S. national stage entry of International Patent Application No. PCT/US2015/025471, filed on Apr. 10, 2015, which claims priority to U.S. Provisional Patent Application No. 61/978,285, filed on Apr. 11, 2014, the entire contents of all of which are fully incorporated herein by reference.

STATEMENT OF GOVERNMENT INTEREST

This invention was made with government support under contract number AI101464 awarded by the National Institutes of Health. The government has certain rights in the invention.

SEQUENCE LISTING

The sequence listing is filed with the application in electronic format only and is incorporated by reference herein. The sequence listing text file "ASFILED_PCT SequenceListing-Text" was created on Apr. 10, 2015 and is 778,599 bytes in size.

TECHNICAL FIELD

The present disclosure relates to molecular virology.

BACKGROUND

Japanese encephalitis virus (JEV) is the most common cause of viral encephalitis in Asia and parts of the Western Pacific, with ~60% of the world's population at risk of infection. Within the family Flaviviridae (genus *Flavivirus*), JEV belongs to the JE serological group, which also includes medically important human pathogens found on every continent except Antarctica: West Nile virus (WNV), St. Louis encephalitis virus (SLEV), and Murray Valley encephalitis virus (MVEV). Historically, the JE serological group members have clustered in geographically distinct locations, but the recent emergence and spread of JEV in Australia and WNV in North America have caused growing concern that these viruses can spread into new territory, posing a significant challenge for global public health. In the US, where WNV and SLEV are endemic, the situation is particularly problematic because the likelihood of JEV being introduced is considerable. Worldwide, ~50,000-175,000 clinical cases of JE are estimated to occur annually; however, this incidence is undoubtedly a considerable underestimate because surveillance and reporting are inadequate in most endemic areas, and only ~0.1-4% of JEV-infected people develop clinical disease. On average, ~20-30% of patients die, and ~30-50% of survivors suffer from irreversible neurological and/or psychiatric sequelae. Most clinical cases occur in children under age 15 in endemic areas, but in newly invaded areas, all age groups are affected because protective immunity is absent. Thus, given the current disease burden and significant threat of the JEV emergence, resurgence, and spread among much larger groups of susceptible populations, control of JEV remains a public health priority.

JEV contains a nucleocapsid composed of an ~11-kb plus-strand genomic RNA, complexed with multiple copies of the highly-basic α-helical C proteins. The nucleocapsid is surrounded by a host-derived lipid bilayer containing the membrane-anchored M and E proteins. The initial step in the flavivirus replication cycle involves attachment of the virions to the surface of susceptible cells. The viral E protein is then assumed to bind with high affinity and specificity to an as-yet unidentified cellular receptor(s), which triggers receptor-mediated, clathrin-dependent endocytosis. The acidic conditions in the endosome lead to a conformational change in the E protein, which triggers fusion of the viral membrane with host endosomal membrane. Once the genome is released into the cytoplasm, the genomic RNA is translated into a single polyprotein, which is processed co- and post-translationally by host and viral proteases to yield at least 10 functional proteins: three structural (C, prM, and E) and seven nonstructural (NS1, NS2A, NS2B, NS3, NS4A, NS4B, and NS5). The nonstructural proteins actively replicate the viral genomic RNA in the replication complex that is associated with the virus-induced, endoplasmic reticulum (ER)-derived membranes. Newly synthesized genomic RNA and C proteins are initially enveloped by the prM and E proteins to generate immature virions that bud into the lumen of the ER. These immature virions are then transported via the secretory pathway to the Golgi apparatus. In the low-pH environment of the trans-Golgi network, the furin-mediated cleavage of prM to M induces the maturation of the viral particles, which is also accompanied by significant structural rearrangements of the M and E proteins. Finally, mature virions are released into the extracellular space by exocytosis.

JEV is maintained in an enzootic cycle involving multiple species of mosquito vectors (primarily *Culex* species) and vertebrate hosts/reservoirs (mainly domestic pigs/wading birds). Humans become infected incidentally when bitten by an infected mosquito. In the absence of antiviral therapy, active immunization is the only strategy for sustainable long-term protection. Four types of JE vaccines are used in different parts of the world: (i) the mouse brain-derived inactivated vaccine based on the Nakayama or Beijing-1 strain, (ii) the cell culture-derived inactivated vaccine based on the Beijing-3 or $SA_{14}$-14-2 strain, (iii) the cell culture-derived live-attenuated vaccine based on the $SA_{14}$-14-2 strain, and (iv) the live chimeric vaccine developed on a yellow fever virus (YFV) 17D genetic background that carries two surface proteins of JEV $SA_{14}$-14-2. Of the four vaccines, the only one that is available internationally is the mouse brain-derived inactivated Nakayama. Unfortunately, the production of this vaccine was discontinued in 2006 because of vaccine-related adverse events, short-term immunity, and high production cost. To date, the most commonly used vaccine in Asia is the live-attenuated $SA_{14}$-14-2, but this vaccine is not recommended by the World Health Organization for global immunization. In addition to the duration of immunity in relation to the number of doses, the most critical issue with this vaccine remains a risk for reversion of the virus to high virulence. Recently, the $SA_{14}$-14-2 vaccine virus has been utilized to produce a new Vero cell-derived inactivated vaccine that has been approved in the US, Europe, Canada, and Australia since 2009. In the US, this vaccine is recommended for adults aged 17 years travelling to JEV-endemic countries and at risk of JEV exposure, but no vaccine is currently available for children under 17. More recently, the prM and E genes of JEV $SA_{14}$-14-2 have been used to replace the corresponding genes of YFV 17D, creating a live chimeric vaccine that is now licensed in Australia and Thailand. Thus, the application of JEV $SA_{14}$-14-2 to vaccine development and production is continuously expanding, but the viral factors and fundamental mechanisms responsible for its loss of virulence are still elusive.

The virulence of JEV is defined by two properties: (i) neuroinvasiveness, the ability of the virus to enter the central nervous system (CNS) when inoculated by a peripheral route; and (ii) neurovirulence, the ability of the virus to replicate and cause damage within the CNS when inoculated directly into the brain of a host. Over the past 20 years, many investigators have sought to understand the molecular basis of JEV virulence, by using cell and animal infection model systems to compare the nucleotide sequences of the genomes of several JEV strains that differ in virological properties. These studies have identified a large number of mutations scattered essentially throughout the entire viral genome. Because of the complexity of the mutations, however, the major genetic determinant(s) critical for either JEV neurovirulence or neuroinvasiveness remains unclear. In particular, the situation is more complicated for the live-attenuated $SA_{14}$-14-2 virus, which has been reported to have a number of different mutations, i.e., 47-64 nucleotide changes (17-27 amino acid substitutions), when compared to its virulent parental strain $SA_{14}$; the exact number depends on both the passage history of the viruses and the type of cell substrate used for virus cultivation. A more comprehensive sequence comparison with another $SA_{14}$-derived attenuated vaccine strain, $SA_{14}$-2-8, together with two other virulent strains, has suggested seven common amino acid substitutions that may be involved in virus attenuation: 4 in E, 1 in NS2B, 1 in NS3, and 1 in NS4B. However, the genetic component directly responsible for the attenuation of $SA_{14}$-14-2 is still unknown. Given that $SA_{14}$-14-2 has been administered to >300 million children for >20 years in China and recently in other Asian countries, it is striking that there is a fundamental gap in our knowledge at the molecular level about how $SA_{14}$-14-2 is attenuated.

SUMMARY

JEV, a mosquito-borne *flavivirus* that causes fatal neurological disease in humans, is one of the most important emerging pathogens of public health significance. JEV represents the JE serogroup, which also includes WNV, SLEV, and MVEV. Within this serogroup, JEV is a vaccine-preventable pathogen, but the molecular basis of its neurovirulence remains unknown. In the present disclosure, we constructed an infectious cDNA of JEV $SA_{14}$, and rescued from the cDNA, a molecularly cloned virus $SA_{14}^{MCV}$. We also constructed an infectious cDNA of the most widely used live-attenuated JE vaccine, $SA_{14}$-14-2, and rescued from the cDNA, a molecularly cloned virus, $SA_{14}$-14-2$^{MCV}$, which displayed in vitro growth properties and in vivo attenuation phenotypes identical to those of its parent, $SA_{14}$-14-2. To elucidate the molecular mechanism of neurovirulence, we selected three independent, highly neurovirulent variants ($LD_{50}$, <1.5 plaque forming unit (PFU)) from $SA_{14}$-14-2$^{MCV}$ ($LD_{50}$, >1.5×10$^5$ PFU) by serial intracerebral passage in mice. Complete genome sequence comparison revealed a total of eight point mutations, with a common single $G^{1708} \rightarrow A$ substitution replacing a Gly with Glu at position 244 of the viral E glycoprotein. Using our infectious $SA_{14}$-14-2 cDNA technology, we showed that this single Gly-to-Glu change at E-244 is sufficient to confer lethal neurovirulence in mice, including rapid development of viral spread and tissue inflammation in the CNS. Comprehensive site-directed mutagenesis of E-244, coupled with homology-based structure modeling, demonstrated a novel essential regulatory role in JEV neurovirulence for E-244, within the ij hairpin of the E dimerization domain. These results provide a crucial step toward developing novel therapeutic and preventive strategies against JEV and possibly other encephalitic flaviviruses.

BRIEF DESCRIPTION OF THE DRAWINGS

FIG. 1. Construction of the full-length infectious $SA_{14}$-14-2 cDNA as a bacterial artificial chromosome (BAC). (A) Structure of the $SA_{14}$-14-2 genomic RNA (GenBank accession no. JN604986). NCR, non-coding region; ORF, open reading frame; nt, nucleotide. (B) Diagram of a panel of four overlapping $SA_{14}$-14-2 cDNAs contained in pBAC/Frag-I to IV. SP6 promoter and an artificial run-off site are shown. An asterisk indicates a pre-existing XbaI site at nucleotide 9131 that was inactivated by introducing a silent point mutation, $A^{9134} \rightarrow T$. (C) Structure of the full-length $SA_{14}$-14-2 cDNA (pBAC/$SA_{14}$-14-2).

FIG. 2. Characterization of biological properties of the molecularly cloned virus $SA_{14}$-14-2$^{MCV}$ in vitro. BHK-21 cells were mock-infected or infected at a multiplicity of infection (MOI) of 1 with the molecularly cloned virus ($SA_{14}$-14-2$^{MCV}$) rescued from the full-length infectious cDNA or the original parental virus ($SA_{14}$-14-2) used for cDNA construction. At the time points indicated, cells were lysed to analyze the accumulation levels of viral genomic RNA by Northern blotting (A) and viral proteins by immunoblotting (B), and culture supernatants were harvested to examine the production levels of progeny virions by plaque titration (C). At 4 days post-infection (dpi), cell monolayers were first immunostained with a mouse α-JEV antiserum to visualize the infectious foci, and the same monolayers were then restained with crystal violet to observe the infectious plaques (D). hpi, hours post-infection.

FIG. 5. Generation of three independent, highly neurovirulent variants from $SA_{14}$-14-2$^{MCV}$ by serial intracerebral passage in mice. Shown is a diagram illustrating the in vivo passage of $SA_{14}$-14-2$^{MCV}$.

FIG. 8. Discovery of a single locus that leads to the reversion of $SA_{14}$-14-2$^{MCV}$ to lethal neurovirulence. Groups of 3-week-old female ICR mice (n=15 per group) were mock-infected or infected IC with $10^3$ PFU of $SA_{14}$-14-2$^{MCV}$ (WT), $G^{1708}A$, or CNU/LP2 (a virulent JEV strain used as a reference). At 3, 5, and 7 days post-infection (dpi), five mice were processed for brain section staining with an α-NS1 antiserum. Shown are representative hippocampal slides.

FIG. 16. Table 2 shows the comparative results of evaluation of in vivo attenuation phenotypes of $SA_{14}$-14-2$^{MCV}$, $SA_{14}$-14-2, and a virulent JEV strain CNU/LP2 in mice.

FIG. 17. Table 3 shows the summary of the virological properties of three $SA_{14}$-14-2$^{MCV}$ variants in mice.

FIG. 18. Table 4 shows the comparison of the neurovirulence and neuroinvasiveness of $SA_{14}$-14-2$^{MCV}$ and its three variants in 3-week-old ICR mice.

FIG. 19. Table 5 shows the comparison of the complete genome sequence of the $SA_{14}$-14-2$^{MCV}$ parental virus and its three variant viruses.

FIG. 20. Table 7 shows the comparison of the neurovirulence of $SA_{14}$-14-2$^{MCV}$ and its eight mutants in 3-week-old ICR mice.

FIG. 21. Table 9 shows the comparison of the neurovirulence of $SA_{14}$-14-2$^{MCV}$ and its 14 E-244 mutants in 3-week-old ICR mice.

FIG. 22. Table 10 shows the sequence analysis of recovered viruses from brain tissues of moribund or dead mice following IC inoculation.

DETAILED DESCRIPTION

Figure 3:
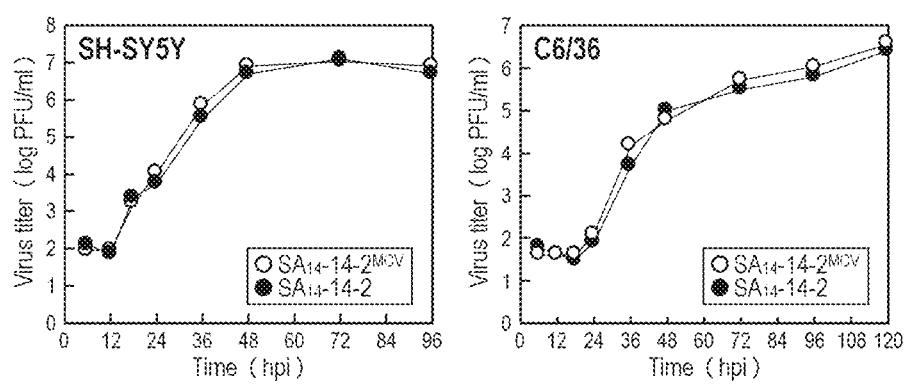
FIG. 3. Viral growth properties of $SA_{14}$-14-2$^{MCV}$ in SH-SY5Y and C6/36 cells. Cells were infected at an MOI of 1 with the molecularly cloned virus ($SA_{14}$-14-2$^{MCV}$) or the original parental virus ($SA_{14}$-14-2). Culture supernatants were collected at the hours post-infection (hpi) indicated, and virus titers were determined by plaque assays on BHK-21 cells. PFU, plaque-forming unit.

In the following description, numerous specific details are provided for a thorough understanding of specific preferred embodiments. However, those skilled in the art will recognize that embodiments can be practiced without one or more of the specific details, or with other methods, components, materials, etc. In some cases, well-known structures, materials, or operations are not shown or described in detail in order to avoid obscuring aspects of the preferred embodiments. Furthermore, the described features, structures, or characteristics may be combined in any suitable manner in a variety of alternative embodiments. Thus, the following detailed description of the embodiments of the present invention, as illustrated in some aspects in the drawings, is not intended to limit the scope of the invention, but is merely representative of the various embodiments of the invention.

In this specification and the claims that follow, singular forms such as "a," "an," and "the" include plural forms unless the content clearly dictates otherwise. All ranges disclosed herein include, unless specifically indicated, all endpoints and intermediate values. In addition, "alternative", "alternatively", or "or" refer, for example, to instances in which subsequently described circumstance may or may not occur, and include instances in which the circumstance occurs and instances in which the circumstance does not occur. The terms "one or more" and "at least one" refer, for example, to instances in which one of the subsequently described circumstances occurs, and to instances in which more than one of the subsequently described circumstances occurs.

The present disclosure in aspects and embodiments addresses the various needs and problems discussed above by providing compositions and methods related to synthetic cDNA molecules and defined polypeptide sequences related to positive-sense RNA viruses. The synthetic cDNAs and defined polypeptides, and the related methods described herein, are useful in developing new therapeutic and preventive measures for viral infections.

Infectious JEV cDNA Molecular Clones

In embodiments, the present disclosure provides an infectious JEV cDNA molecular clone comprising at least one synthetic, full-length cDNA molecule encoding an infectious positive-sense RNA molecule. Infectious JEV cDNAs of the present disclosure may be generated using at least one of the methods or steps described herein.

Synthetic cDNAs and Defined Polypeptides

As used herein, terms referring to nucleic acid molecules such as "synthetic cDNAs", may include both single-stranded and double-stranded DNA molecules. Any reference to a "Sequence Listing" or a "SEQ ID NO" is intended to refer to both the DNA of the "Sequence Listing", as well as RNA corresponding to the DNA sequence, and includes sequences complementary to the DNA and RNA sequences. In such contexts in this application, "corresponding to" refers to sequences of DNA and RNA that are identical to one another but for the fact that the RNA sequence contains uracil in place of thymine and the backbone of the RNA molecule contains ribose instead of deoxyribose. For example, SEQ ID NO:1 is a cDNA sequence corresponding to the genomic RNA of JEV $SA_{14}$-14-2. A DNA sequence complementary to the cDNA sequence set forth in SEQ ID NO:1 is a template for synthesis of the genome-length RNA of the infectious $SA_{14}$-14-2 cDNA. Nonetheless, a reference herein to SEQ ID NO:1 includes both the RNA sequence corresponding to SEQ ID NO:1 and the DNA sequence complementary to SEQ ID NO:1. In another example, SEQ ID NO:32 is a cDNA sequence corresponding to the genomic RNA of JEV $SA_{14}$. A DNA sequence complementary to the cDNA sequence set forth in SEQ ID NO:32 is a template for synthesis of the genome-length RNA of the infectious $SA_{14}$ cDNA. Nonetheless, a reference herein to SEQ ID NO:32 includes both the RNA sequence corresponding to SEQ ID NO:32 and the DNA sequence complementary to SEQ ID NO:32.

References to sequences homologous to a sequence, or sequence listing, are to be understood to include sequences homologous to a sequence corresponding to the referenced sequence and sequences homologous to a sequence complementary to the referenced sequence.

An "infectious RNA molecule", for purposes of the present invention, is an RNA molecule that encodes the genetic elements necessary for viral replication, transcription, and translation, capable of producing infectious virions in a suitable host cell.

For purposes of the present disclosure, the nucleotide sequence of a second DNA/RNA molecule is "homologous" to that of a first DNA/RNA molecule where the second DNA/RNA molecule encodes the same polypeptide as the first DNA/RNA molecule based on the degeneracy of the genetic code, or when it encodes a polypeptide that is sufficiently similar to the polypeptide encoded by the first DNA/RNA molecule so as to provide at least one in-vivo or in-vitro biological function that corresponds to a function of the polypeptide encoded by the first DNA/RNA molecule. For purposes of the present disclosure, biological functions include any feature or activity related to the neuroinvasiveness or neurovirulence of a *flavivirus*. Preferably, the function is related to the neuroinvasiveness or neurovirulence of JEV. It is to be understood that the polypeptide can comprise a group of two or more polypeptides.

Generally, the nucleotide sequence of a second DNA/RNA molecule is homologous to that of a first DNA/RNA molecule if it has at least about 70% nucleotide sequence identity to the first DNA/RNA molecule based on the BLASTN algorithm (National Center for Biotechnology Information, otherwise known as NCBI, [Bethesda, Md., USA] of the United States National Institutes of Health). Preferably, a homologous nucleotide sequence has at least about 75% nucleotide sequence identity, even more preferably at least about 80%, 81%, 82%, 83%, 84%, 85%, 86%, 87%, 88%, 89%, 90%, 91%, 92%, 93%, 94%, 95%, 96%, 97%, 98%, or 99% nucleotide sequence identity. Since the genetic code is degenerate, a homologous nucleotide sequence can include any number of "silent" base changes, i.e. nucleotide substitutions that nonetheless encode the same amino acid. A homologous nucleotide sequence can further contain non-silent mutations, i.e. base substitutions, deletions, or insertions resulting in amino acid differences in the encoded polypeptide, so long as the sequence remains at least about 70% identical to the polypeptide encoded by the first nucleotide sequence or otherwise provides at least one in-vivo or in-vitro biological function that corresponds to a function of the polypeptide encoded by the first DNA/RNA molecule.

Homologous nucleotide sequences can be determined by comparison of nucleotide sequences, for example by using BLASTN. Alternatively, homologous nucleotide sequences can be determined by hybridization under selected conditions. For example, the nucleotide sequence of a second DNA/RNA molecule is homologous to SEQ ID NO:1 if it hybridizes to the complement of SEQ ID NO:1 under moderately stringent conditions, e.g., hybridization to filter-bound DNA/RNA in a traditional hybridization buffer (0.25 M sodium phosphate [pH 7.2], 7% sodium dodecyl sulfate (SDS), and 2 mM EDTA) and washing in a moderate stringency wash buffer (0.5×SSC and 0.1% SDS). In another embodiment, the nucleotide sequence of a second DNA/RNA molecule is homologous to SEQ ID NO:1 if it hybridizes to the complement of SEQ ID NO:1 under highly stringent conditions, e.g. hybridization to filter-bound DNA/RNA in a traditional hybridization buffer (0.25 M sodium phosphate [pH 7.2], 7% SDS, and 2 mM EDTA) and washing in a high stringency wash buffer (0.1×SSC and 0.1% SDS).

"Identical" or "identity" as used herein in the context of two or more nucleic acids (e.g., DNA and/or RNA) or polypeptide sequences means that the sequences have a specified percentage of residues that are the same over a specified region. The percentage can be calculated by optimally aligning the two sequences (and introducing gaps, if necessary), comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces one or more staggered ends and the specified region of comparison includes only a single sequence, the residues of single sequence are included in the denominator but not the numerator of the calculation. When comparing DNA and RNA, thymine (T) and uracil (U) can be considered equivalent. Identity can be performed manually or by using a computer sequence algorithm such as BLAST or BLAST 2.0.

In embodiments, the present disclosure provides a synthetic cDNA molecule encoding a genome-length RNA molecule capable of producing infectious viral particles. The cDNA molecule may have at least one silent single point mutation to eliminate a pre-existing internal XbaI restriction site. Also, the cDNA molecule may be configured for in-vitro run-off transcription.

In embodiments, the cDNA molecule may be double-stranded DNA, having a DNA sequence corresponding to the viral genomic RNA, and further comprising a complementary strand of cDNA.

In embodiments, the cDNA molecule may include the nucleotide sequence set forth in SEQ ID NO:1, which encodes a JEV genomic RNA of JEV SA$_{14}$-14-2. The cDNA molecule may consist of the nucleotide sequence set forth in SEQ ID NO:1. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:1. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:3.

In embodiments, the cDNA molecule may have a mutation, e.g., a single G to A substitution at nucleotide 1708 of JEV genomic RNA that results in a Gly to Glu change at amino acid 244 of the viral E glycoprotein. The cDNA molecule may include the nucleotide sequence set forth in SEQ ID NO:4. The cDNA molecule may consist of the nucleotide sequence set forth in SEQ ID NO:4. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:4. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:18.

In embodiments, the cDNA molecule may have a mutation that results in a Gly to Asp change at amino acid 244 of the viral E glycoprotein. The cDNA molecule may include the nucleotide sequence set forth in SEQ ID NO:5. The cDNA molecule may consist of the nucleotide sequence set forth in SEQ ID NO:5. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:5. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:19.

In embodiments, the cDNA molecule may have a mutation that results in a Gly to Thr change at amino acid 244 of the viral E glycoprotein. The cDNA molecule may include the nucleotide sequence set forth in SEQ ID NO:6. The cDNA molecule may consist of the nucleotide sequence set forth in SEQ ID NO:6. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:6. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:20.

In embodiments, the cDNA molecule may have a mutation that results in a Gly to Ser change at amino acid 244 of the viral E glycoprotein. The cDNA molecule may include the nucleotide sequence set forth in SEQ ID NO:7. The cDNA molecule may consist of the nucleotide sequence set forth in SEQ ID NO:7. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:7. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:21.

In embodiments, the cDNA molecule may have a mutation that results in a Gly to Gln change at amino acid 244 of the viral E glycoprotein. The cDNA molecule may include the nucleotide sequence set forth in SEQ ID NO:8. The cDNA molecule may consist of the nucleotide sequence set forth in SEQ ID NO:8. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:8. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:22.

In embodiments, the cDNA molecule may have a mutation that results in a Gly to Pro change at amino acid 244 of the viral E glycoprotein. The cDNA molecule may include the nucleotide sequence set forth in SEQ ID NO:9. The cDNA molecule may consist of the nucleotide sequence set forth in SEQ ID NO:9. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:9. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:23.

In embodiments, the cDNA molecule may have a mutation that results in a Gly to Arg change at amino acid 244 of the viral E glycoprotein. The cDNA molecule may include the nucleotide sequence set forth in SEQ ID NO:10. The cDNA molecule may consist of the nucleotide sequence set forth in SEQ ID NO:10. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:10. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:24.

In embodiments, the cDNA molecule may have a mutation that results in a Gly to Lys change at amino acid 244 of the viral E glycoprotein. The cDNA molecule may include the nucleotide sequence set forth in SEQ ID NO:11. The cDNA molecule may consist of the nucleotide sequence set forth in SEQ ID NO:11. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:11. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:25.

In embodiments, the cDNA molecule may have a mutation that results in a Gly to Phe change at amino acid 244 of the viral E glycoprotein. The cDNA molecule may include the nucleotide sequence set forth in SEQ ID NO:12. The cDNA molecule may consist of the nucleotide sequence set forth in SEQ ID NO:12. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:12. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:26.

In embodiments, the cDNA molecule may have a mutation that results in a Gly to Trp change at amino acid 244 of the viral E glycoprotein. The cDNA molecule may include the nucleotide sequence set forth in SEQ ID NO:13. The cDNA molecule may consist of the nucleotide sequence set forth in SEQ ID NO:13. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:13. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:27.

In embodiments, the cDNA molecule may have a mutation that results in a Gly to Asn change at amino acid 244 of the viral E glycoprotein. The cDNA molecule may include the nucleotide sequence set forth in SEQ ID NO:14. The cDNA molecule may consist of the nucleotide sequence set forth in SEQ ID NO:14. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:14. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:28.

In embodiments, the cDNA molecule may have a mutation that results in a Gly to Leu change at amino acid 244 of the viral E glycoprotein. The cDNA molecule may include the nucleotide sequence set forth in SEQ ID NO:15. The cDNA molecule may consist of the nucleotide sequence set forth in SEQ ID NO:15. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:15. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:29.

In embodiments, the cDNA molecule may have a mutation that results in a Gly to Ala change at amino acid 244 of the viral E glycoprotein. The cDNA molecule may include the nucleotide sequence set forth in SEQ ID NO:16. The cDNA molecule may consist of the nucleotide sequence set forth in SEQ ID NO:16. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:16. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:30.

In embodiments, the cDNA molecule may have a mutation that results in a Gly to Val change at amino acid 244 of the viral E glycoprotein. The cDNA molecule may include the nucleotide sequence set forth in SEQ ID NO:17. The cDNA molecule may consist of the nucleotide sequence set forth in SEQ ID NO:17. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:17. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:31.

In embodiments, the cDNA molecule may include the nucleotide sequence set forth in SEQ ID NO:32, which encodes a JEV genomic RNA of JEV $SA_{14}$. The cDNA molecule may consist of the nucleotide sequence set forth in SEQ ID NO:32. The cDNA molecule may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:32. The cDNA molecule may include a nucleic acid sequence that encodes an amino acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the amino acid sequence set forth in SEQ ID NO:34.

DNA Construct

In embodiments, the present disclosure provides a DNA construct that comprises one or more of the above-described cDNA molecules. The DNA construct may include a bacterial artificial chromosome. The DNA construct may be a vector or plasmid, or located within a vector or plasmid. The DNA construct may include a promoter, for example, a SP6 promoter. The DNA construct may include an origin of replication in order to maintain the DNA construct extrachromosomally and produce single or multiple copies of the DNA construct in a cell. The DNA construct may include the genetic elements necessary to facilitate in vitro run-off transcription of RNA.

In embodiments when the cDNA molecule comprises or consists of the nucleotide sequence as set for in SEQ ID NO:1, the DNA construct may comprise or consist of the nucleotide sequence set forth in SEQ ID NO:2. This DNA construct may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:2.

In embodiments when the cDNA molecule comprises or consists of the nucleotide sequence as set for in SEQ ID NO:32, the DNA construct may comprise or consist of the nucleotide sequence set forth in SEQ ID NO:33. This DNA construct may include a nucleic acid sequence having at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity over an entire length of the nucleotide sequence set forth in SEQ ID NO:33.

Vaccine

Also provided herein is a vaccine. The vaccine may comprise a JEV virion or components thereof. The JEV virion may include an RNA encoded by the above-described cDNA molecule. The vaccine may also include a pharmaceutically acceptable excipient, for example, but not limited to, a vehicle, adjuvant, carrier, or diluent. The adjuvant may be any molecule added to the vaccine to enhance the immunogenicity of the JEV virion or components thereof. The adjuvant may be Freund's complete or incomplete adjuvant, monophosphoryl Lipid A, an emulsion (e.g., oil-in-water emulsion), alum, or a cytokine, or any combination thereof.

The vaccine may further comprise other agents for formulation purposes according to the mode of administration to be used. In cases where the vaccine is an injectable vaccine, the vaccine may be sterile, pyrogen free, and particulate free. The vaccine may be formulated to be isotonic. Generally, additives for isotonicity may include sodium chloride, dextrose, mannitol, sorbitol and lactose, and/or an isotonic solution such as phosphate buffered saline.

Method of Treatment and/or Prevention

Provided herein is a method of treating and/or preventing a disease associated with JEV in a subject in need thereof. The term "treat," "treating," or "treatment" as used herein interchangeably means to reverse, alleviate, or inhibit the progress of a disease, or one or more symptoms of such disease, to which such term applies. Depending on the condition of the subject, the term also refers to preventing a disease, and includes preventing the onset of a disease, or preventing symptoms associated with a disease. A treatment may be either performed in an acute or chronic way. The term also refers to reducing the severity of a disease or symptoms associated with such disease prior to affliction with the disease. "Preventing" also refers to preventing the recurrence of a disease with one or more symptoms associated with such disease. "Treatment" and "therapeutically" refer to the act of treating as "treating" is defined above.

The method may include administering the above-described vaccine to the subject. The subject may be a vertebrate animal, for example, but not limited to, a human, chimpanzee, dog, cat, horse, cow, mouse, pig, or rat. The vaccine may be administered by different routes including orally, parenterally, sublingually, transdermally, rectally, transmucosally, topically, via inhalation, via buccal administration, intrapleurally, intravenously, intraarterially, intraperitoneally, subcutaneously, intramuscularly, intranasally, intrathecally, and intraarticularly or any combination thereof. The vaccine may be administered by traditional syringes, needleless injection devices, "microprojectile bombardment guns", or other physical methods such as electroporation ("EP"), "hydrodynamic method", or ultrasound.

Method of Identifying a Drug Agent that Targets an Ij-Hairpin of a Flavivirus.

Also provided herein is a method of identifying a drug agent that targets an ij-hairpin of a *flavivirus*. The ij-hairpin may be located in the glycoprotein E of the *flavivirus*. The flavivirus may be JEV, WNV, SLEV, MVEV, DENV, YFV, or tick-borne encephalitis virus. JEV may include an RNA encoded by the cDNA molecule described above. JEV may include an RNA that encodes an amino acid sequence which is also encoded by the cDNA molecule described above.

The drug agent may inhibit or suppress viral entry into a cell, thereby inhibiting or suppressing viral infection and replication. The drug agent may be a small molecule, a peptide, or an antibody, or any combination thereof. The drug agent may decrease a level of viral RNA, proteins, or particles as compared to a level of the viral RNA, proteins, or particles in the absence of the drug agent. The viral protein may be C, prM/M, E, NS1/1', NS2A, NS2B, NS3, NS4A, NS4B, or NS5 protein, or any combination thereof.

In embodiments, the method may include exposing cells capable of being infected with a flavivirus to experimental conditions that lead to productive infection. In a productive infection, the flavivirus expresses its gene products and replicates its genome, thereby producing progeny virions capable of infecting other cells.

The method may also include adding a candidate drug agent to the cells before or after infection. The method may further include mixing the candidate drug agent with the flavivirus (or the cells or both the cells and flavivirus). Mixing may occur prior to infection.

The method may also include determining the level of the viral RNA, proteins, or particles in the presence and absence of the candidate drug agent. The level of viral RNA may be determined by, but is not limited to, Northern blotting and reverse-transcription polymerase chain reaction (RT-PCR). The level of viral proteins may be determined by, but is not limited to, an immunoassay (e.g., ELISA and western blotting). The level of viral particles may be determined by, but is not limited to, measuring virus titer (e.g., plaque/focus assay).

The method may further include identifying the candidate drug agent as a drug agent (i.e., therapeutic agent) targeting the ij-hairpin when the level of the viral RNA, proteins, or particles in the presence of the candidate drug agent is decreased as compared to the level of the viral RNA, proteins, or particles in the absence of the candidate drug agent.

The following examples are illustrative only and are not intended to limit the disclosure in any way.

EXAMPLES

Example 1. Summary for Examples 1-10

The present invention reports the first development of an infectious cDNA-based reverse genetics system for JEV $SA_{14}$-14-2 that has enabled the analysis of molecular aspects of its attenuation in neurovirulence. By in vivo passage of a molecularly defined, cDNA-derived $SA_{14}$-14-2 virus, three isogenic variants have been generated, each displaying lethal neurovirulence in mice, with a common single $G^{1708} \rightarrow A$ substitution that corresponds to a Gly-Glu change at position 244 of the viral E glycoprotein. By in vitro site-directed mutagenesis of the infectious $SA_{14}$-14-2 cDNA, coupled with conventional virologic and experimental pathologic methods and homology-based structure modeling, we have demonstrated a novel regulatory role in JEV neurovirulence of a conserved single amino acid at position E-244 in the ij hairpin adjacent to the fusion loop of the E dimerization domain. These findings offer new insights into the molecular mechanism of JEV neurovirulence and will directly aid the development of new approaches to treating and preventing JEV infection.

Figure 1:
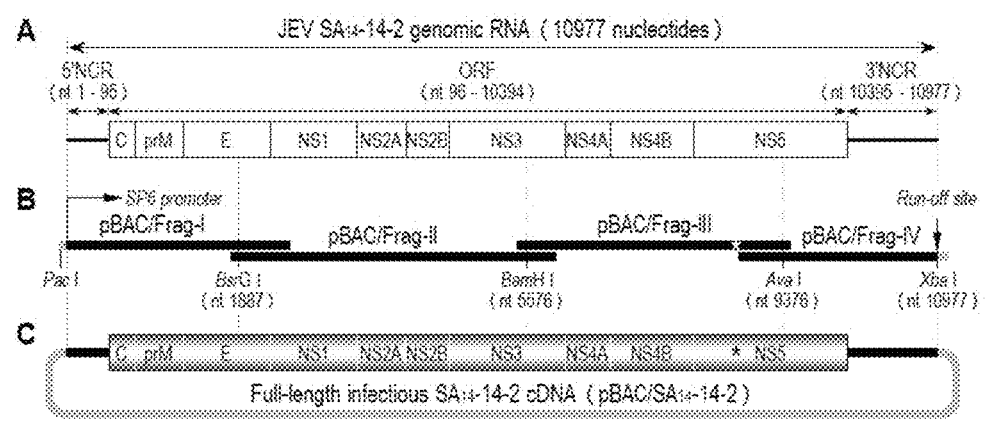

Example 2. Construction and Characterization of a Full-Length Infectious cDNA of $SA_{14}$-14-2, a Live JE Vaccine Virus A full-length infectious cDNA of JEV $SA_{14}$-14-2 was constructed to serve as a template for genetic manipulation of the viral genome (FIG. 1A). A bacterial artificial chromosome (BAC) was used to house the full-length $SA_{14}$-14-2 cDNA. The 10,977-nucleotide genome of $SA_{14}$-14-2 was first cloned as four contiguous cDNAs into the BAC, designated pBAC/Frag-I to IV (FIG. 1B). pBAC/Frag-I was modified to have an SP6 promoter immediately upstream of the viral 5'-end, and pBAC/Frag-IV was engineered to contain an artificial XbaI run-off site just downstream of the viral 3'-end, allowing in vitro run-off transcription of capped, genome-length RNAs bearing authentic 5' and 3' ends of the genomic RNA. Since the viral genome already had an internal XbaI site at nucleotide 9131 in the NS5 protein-coding region, this pre-existing site was eliminated in pBAC/Frag-III by introducing a silent point mutation, $A^{9134} \rightarrow T$ (FIG. 1B, asterisk), which in turn served as a genetic marker to identify the cDNA-derived virus. In the last cloning step, a panel of the four overlapping $SA_{14}$-14-2 cDNAs was sequentially assembled by joining at three natural restriction sites (BsrGI, BamHI, and AvaI) to create the full-length $SA_{14}$-14-2 cDNA, pBAC/$SA_{14}$-14-2 (FIG. 1C).

The functionality of pBAC/$SA_{14}$-14-2 was analyzed by determining the specific infectivity of the synthetic RNAs transcribed in vitro from the cDNA after RNA transfection into susceptible BHK-21 cells (Table 1). Two independent clones of pBAC/$SA_{14}$-14-2 were linearized by XbaI, followed by mung bean nuclease treatment to remove the 5' overhang left by the XbaI digestion. Each was then used as a template for SP6 RNA polymerase run-off transcription in the presence of the $m^7G(5')ppp(5')A$ cap structure analog. The transcription reactions equally produced the capped synthetic RNAs with authentic 5' and 3' ends of the $SA_{14}$-14-2 genomic RNA. Transfection of the synthetic RNAs into BHK-21 cells gave specific infectivities of 6.0-7.5×10$^5$ plaque-forming unit (PFU)/µg; the virus titers recovered from the RNA-transfected cells were 3.0-4.5×10$^5$ PFU/ml at 22 hours post-transfection (hpt) and increased ~10-fold to 2.9-3.7×10$^6$ PFU/ml at 40 hpt. Unequivocally, the recovered virus contained the marker mutation ($A^{9134} \rightarrow T$) that had been introduced in pBAC/$SA_{14}$-14-2. These results show that the synthetic RNAs generated from the full-length $SA_{14}$-14-2 cDNA are highly infectious in BHK-21 cells, producing a high titer of molecularly defined, infectious virus.

TABLE 1

Functionality of pBAC/$SA_{14}$-14-2.

| Template used for transcription | RNA infectivity (PFU/µg) | Virus yield (PFU/ml) | |
|---|---|---|---|
| | | 22 hpt | 40 hpt |
| pBAC/$SA_{14}$-14-2 (clone 1) | 7.5 × 10$^5$ | 4.5 × 10$^6$ | 3.7 × 10$^6$ |
| pBAC/$SA_{14}$-14-2 (clone 2) | 6.0 × 10$^5$ | 3.0 × 10$^5$ | 2.9 × 10$^6$ |

After in vitro transcription with SP6 RNA polymerase, RNA transcripts were electroporated into BHK-21 cells, and infectious plaque centers were determined (RNA infectivity). At 22 and 40 hours post-transfection (hpt), supernatants from RNA-transfected cells were harvested for virus titration (virus yield). PFU, plaque-forming unit.

Figure 2:
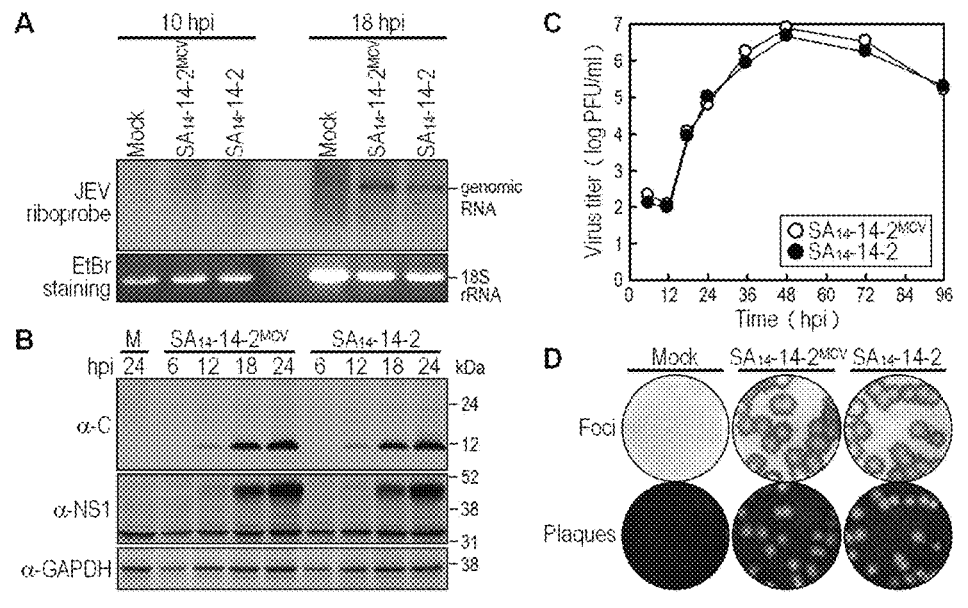

Example 3. Characterization of In Vitro and In Vivo Biological Properties of the Molecularly Cloned Virus $SA_{14}$-14-$2^{MCV}$ Cell culture systems were used to examine the in vitro growth properties of the molecularly cloned virus ($SA_{14}$-14-$2^{MCV}$) rescued from the infectious cDNA, as compared to those of the uncloned parental virus ($SA_{14}$-14-2) used for cDNA construction. In hamster kidney BHK-21 cells, which are used most frequently for JEV propagation in laboratories, $SA_{14}$-14-$2^{MCV}$ replicated as efficiently as $SA_{14}$-14-2, with no noticeable difference in the accumulation of viral genomic RNA (FIG. 2A) and proteins (FIG. 2B) over the first 24 hours after infection at a multiplicity of infection (MOI) of 1 PFU per cell. These observations were consistent with their growth kinetics, which were essentially identical for 4 days following infection (FIG. 2C). Similarly, there was no difference in focus/plaque morphology between the viruses at 4 days post-infection (dpi) (FIG. 2D). Also, their growth properties were equivalent in two other cell lines, human neuroblastoma SH-SY5Y and mosquito C6/36 cells, which are potentially relevant to JEV pathogenesis and transmission, respectively (FIG. 3). These data suggest that the uncloned parental and molecularly cloned viruses are indistinguishable in viral replication and spread in both mammalian and insect cells.

Figure 4:
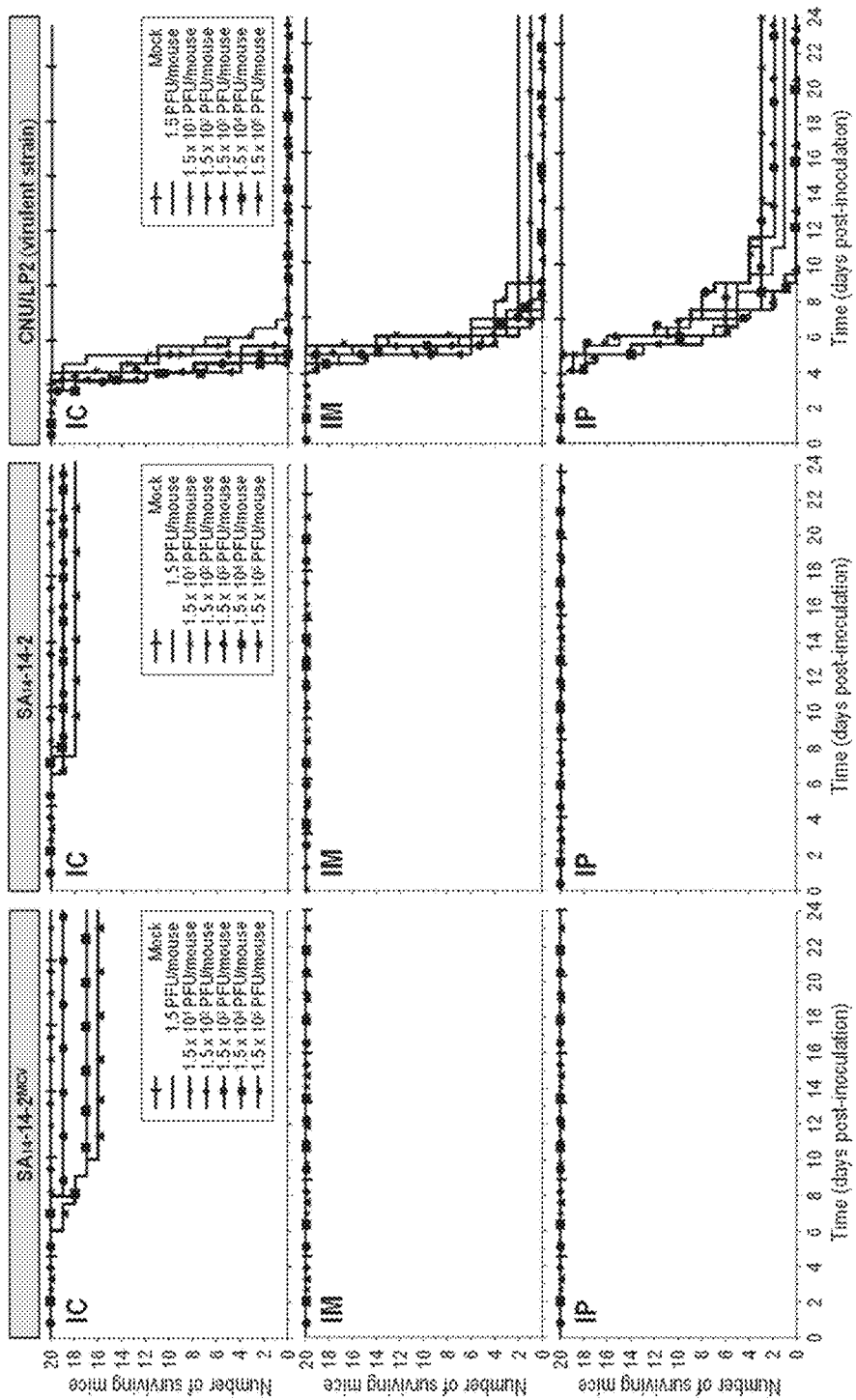
FIG. 4. Virological properties of $SA_{14}$-14-2$^{MCV}$ in mice. Groups of 3-week-old female ICR mice (n=20 per group) were mock-inoculated or inoculated intracerebrally (IC), intramuscularly (IM), or intraperitoneally (IP) with serial 10-fold dilutions of $SA_{14}$-14-2$^{MCV}$, $SA_{14}$-14-2, or CNU/LP2 (a virulent JEV strain used as a reference). Mice were observed for any JEV-induced clinical signs and death every 12 hours for 24 days. Survival curves were plotted by the Kaplan-Meier method.

In mice, the in vivo attenuation phenotypes of $SA_{14}$-14-$2^{MCV}$ and $SA_{14}$-14-2 were evaluated with a virulent JEV strain CNU/LP2 in parallel. Groups of 3-week-old ICR mice (n=20 per group) were infected with various doses (1.5 to $1.5 \times 10^5$ PFU/mouse) of each virus, via three different inoculation routes: intracerebral (IC) for neurovirulence, and intramuscular (IM) and intraperitoneal (IP) for neuroinvasiveness. As with $SA_{14}$-14-2, the 50% lethal doses ($LD_{50}$s) of $SA_{14}$-14-$2^{MCV}$, regardless of the route of inoculation, were all >$1.5 \times 10^5$ PFU (Table 2 and FIG. 4). Specifically, all mice infected with $SA_{14}$-14-$2^{MCV}$ or $SA_{14}$-14-2 remained healthy and displayed no clinical signs of JEV infection (e.g., ruffled fur, hunched posture, tremors, or hindlimb paralysis) after IM or IP inoculation with any of the tested doses; on the other hand, a small fraction of the mice infected with $SA_{14}$-14-$2^{MCV}$ (5-20%) or $SA_{14}$-14-2 (5-10%) developed typical symptoms and death after the IC inoculation with a relatively high dose of ≥$0.1.5 \times 10^3$ PFU/mouse, but not the low dose of ≤$1.5 \times 10^2$ PFU/mouse (FIG. 4). In all dead or surviving mice, virus titration confirmed the presence (1.8-4.1×$10^6$ PFU/brain) or absence, respectively, of viral replication in their brain tissues. As expected, the $LD_{50}$ values of CNU/LP2, irrespective of the inoculation route, were always <1.5 PFU (Table 2 and FIG. 4); the control groups of mock-infected mice all survived with no signs of disease (FIG. 4). Thus, these data indicate that $SA_{14}$-14-$2^{MCV}$ displays a variety of biological properties identical to those of $SA_{14}$-14-2, both in vitro and in vivo.

Groups of 3-week-old mice (n=20 per group) were infected IC, IM, or IP with serial 10-fold dilutions of each virus as indicated. The $LD_{50}$ values (in PFU) were calculated by the Reed and Muench method. CNU/LP2, a virulent JEV strain used as a reference.

Figure 5:
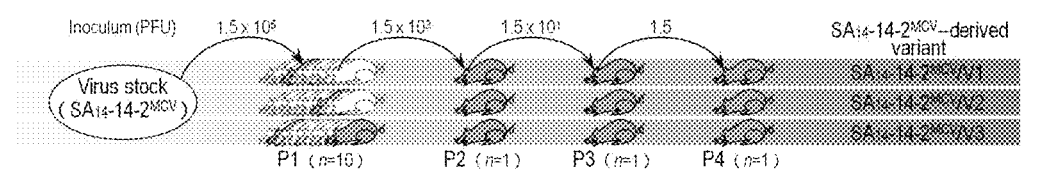

Example 4. Generation of Three Highly Neurovirulent Variants Derived from $SA_{14}$-14-$2^{MCV}$ As was true for $SA_{14}$-14-2, direct inoculation of a relatively high dose of $SA_{14}$-14-$2^{MCV}$ into mouse brains initiated a productive infection in the CNS and caused lethal encephalitis, albeit at a very low frequency (FIG. 4). Intrigued by this observation, isogenic neurovirulent variants from $SA_{14}$-14-$2^{MCV}$ were generated by serial brain-to-brain passage in mice (FIG. 5). At passage 1 (P1), the cDNA-derived $SA_{14}$-14-$2^{MCV}$ was directly inoculated into the brains of 3-week-old ICR mice at $1.5 \times 10^5$ PFU/mouse (three groups, n=10 per group); one or two infected mice per group exhibited clinical symptoms of JEV infection. At the onset of hindlimb paralysis (6-10 dpi), virus was harvested from the brain of a moribund mouse in each group (3 total); in each case, a brain homogenate was prepared for plaque titration and used as an inoculum for the next round of passage. Serial intracerebral passage was continued for three additional rounds, with a gradually decreasing inoculum in order to ensure the stability of selected mutations and a sufficiently pure population of viruses: 1500 (P2), to 15 (P3), to 1.5 PFU/mouse (P4). Using this approach, three independently selected variants, designated $SA_{14}$-14-$2^{MCV}$/V1 to V3, were generated (FIG. 5).

The biological properties of the three $SA_{14}$-14-$2^{MCV}$ variants were compared to those of the parental $SA_{14}$-14-$2^{MCV}$, both in vitro and in vivo. In three cell cultures (BHK-21, SH-SY5Y, and C6/36), all three variants exhibited characteristics of viral replication identical to the parent, as demonstrated by (i) quantitative real-time RT-PCRs to measure the level of viral genomic RNA production, (ii) immunoblotting with a panel of JEV-specific rabbit polyclonal antisera to probe the profile and level of viral structural and nonstructural protein accumulation, and (iii) one-step growth analyses to assess the yield of progeny virions produced during a single round of infection. In 3-week-old ICR mice, however, there was a clear difference between the parent and the three variants in both phenotype and virulence level (Table 3). When peripherally inoculated (i.e., IM and IP), neither the parent nor its three variants caused any symptoms or death at a maximum dose of $1.5 \times 10^5$ PFU/mouse. In contrast, when inoculated IC, the three variants, unlike the parent (IC $LD_{50}$, >$1.5 \times 10^5$ PFU), were all highly neurovirulent (IC $LD_{50}$s, <1.5 PFU) (Table 3 and Table 4). These findings show that all three variants still lacked a detectable level of neuroinvasiveness but gained a high level of neurovirulence after serial IC passage in mice.

Groups of 3-week-old ICR mice (n=10 per group) were inoculated IC, IM, or IP with doses of the virus stock serially diluted 10-fold. The $LD_{50}$ values were determined.

Next, the complete nucleotide sequence of the genome of the three $SA_{14}$-14-$2^{MCV}$ variants was determined to identify the nucleotide(s) and/or amino acid(s) in specific viral loci/genes that is(are) potentially responsible for the drastic increase in neurovirulence. The consensus genome sequence of each variant was generated by direct sequencing of three overlapping, uncloned cDNA amplicons covering the entire viral RNA genome except the 5'- and 3'-termini; the remaining consensus sequences of the 5'- and 3'-terminal regions were obtained by 5'- and 3'-RACE (rapid amplification of cDNA ends) reactions, each followed by cDNA cloning and sequencing of 10-15 independent clones. In all three variants, when the consensus genome sequence was compared to that of the parent, a single nucleotide G-to-A transition was always found at nucleotide 1708, changing a Gly (G<u>G</u>G) to Glu (G<u>A</u>G) codon at amino acid 244 of the viral E glycoprotein (Table 5). In addition, each of the three variants also contained a small number of unique silent point mutations scattered over the genome, confirming they were indeed independent variants (Table 5): one in $SA_{14}$-14-$2^{MCV}$/V1 ($U^{2580}C$), two in $SA_{14}$-14-$2^{MCV}$/V2 ($G^{317}A$ and $U^{8588}C$), and four in $SA_{14}$-14-$2^{MCV}$/V3 ($U^{419}c$, $C^{3215}U$, $C^{5987}U$, and $G^{6551}A$). These results suggest that the $G^{1708}A$ substitution, the only mutation observed in all three variants, may contribute to the viral neurovirulence in mice.

Figure 6:
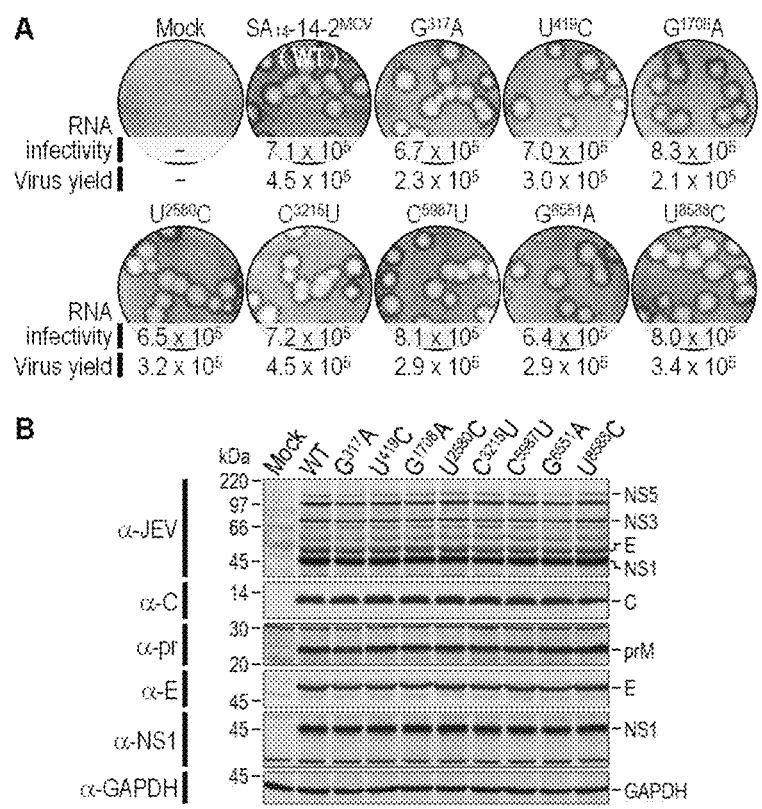
FIG. 6. In vitro replicability of $SA_{14}$-14-2$^{MCV}$ and its eight mutants. BHK-21 cells were mock-transfected or transfected with RNAs transcribed from $SA_{14}$-14-2$^{MCV}$ (WT) or each mutant cDNA, as indicated. RNA infectivity (in PFU/μg) at 4 days post-transfection (dpt) was determined by infectious center assay, combined with staining of cell monolayers using an α-JEV antiserum, and virus yield (in PFU/ml) at 22 hours post-transfection (hpt) was measured by plaque titration (A); viral protein accumulation at 18 hpt was examined by immunoblotting of cell lysates with a panel of antibodies as indicated (B). In parallel, GAPDH protein was used as a loading and transfer control.
Figure 7:
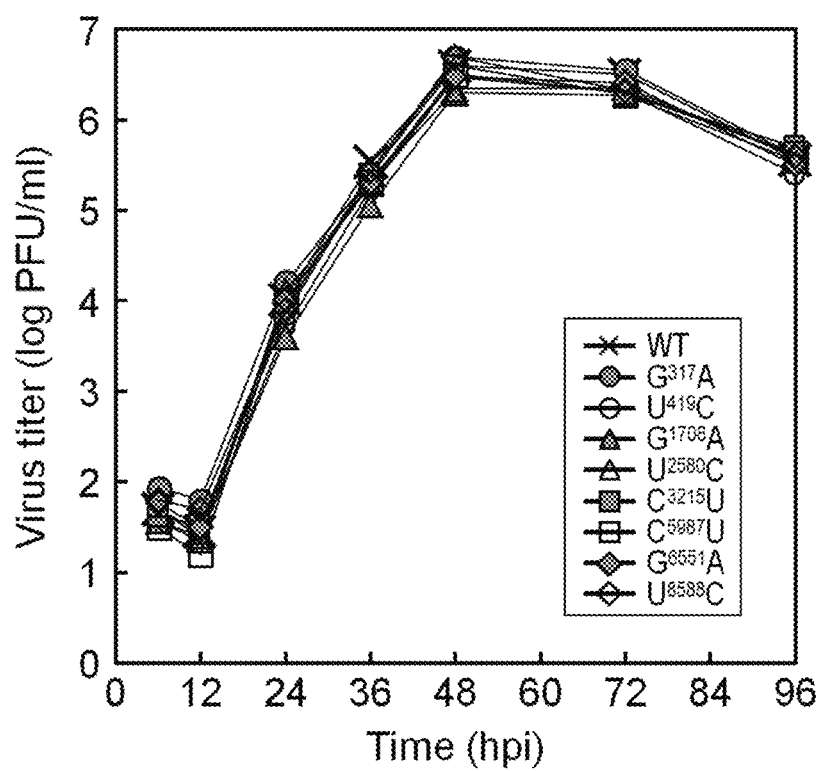
FIG. 7. Viral growth properties of $SA_{14}$-14-2$^{MCV}$ and its eight mutants. BHK-21 cells were infected at an MOI of 0.1 with $SA_{14}$-14-2$^{MCV}$ (WT) or each mutant virus obtained from the corresponding RNA-transfected cells. At the indicated time points, culture supernatants harvested for virus titration.

Example 5. Identification of a Single Gly-to-Glu Change at Position E-244 that is Responsible for the Reversion to Neurovirulence To identify a key point mutation(s) in three variants of $SA_{14}$-14-$2^{MCV}$ that leads to the acquisition of neurovirulence, eight derivatives of $SA_{14}$-14-$2^{MCV}$ were generated, each containing one of the eight point mutations found in three $SA_{14}$-14-$2^{MCV}$ variants, by cloning them individually into the infectious $SA_{14}$-14-2 cDNA and transfecting the synthetic RNAs derived from each mutant cDNA into BHK-21 cells. In all cases, the mutant RNA was as infectious as the parental wild-type (WT) RNA with a specific infectivity of $6.4$-$8.3 \times 10^5$ PFU/µg; the sizes of the foci/plaques produced by each mutant RNA were indistinguishable from those generated by WT RNA, paralleling their levels of virus production, with an average yield of $2.1$-$4.5 \times 10^5$ PFU/ml at 22 hpt (FIG. 6A). In agreement with these results, no difference was observed in the profile or expression level of the viral proteins, i.e., three structural (C, prM, and E) and one nonstructural (NS1), as determined by immunoblotting of RNA-transfected cells at 18 hpt (FIG. 6B). All the mutant viruses grew as efficiently as did the WT virus over the course of 96 hours after infection at an MOI of 0.1 in BHK-21 cells (FIG. 7). Thus, there was no apparent effect of any of the eight introduced genetic changes on virus replication.

The neurovirulence of these eight mutant viruses was examined in mice. Groups of 3-week-old ICR mice (n=10 per group) were infected by IC inoculation with various doses (1.5 to $1.5 \times 10^5$ PFU/mouse) of WT or each mutant virus. One of the eight mutants containing the $G^{1708}A$ substitution had an IC $LD_{50}$ of <1.5 PFU, making it capable of killing all mice within ~7 dpi with a minimum dose of 1.5 PFU/mouse; the other seven mutants had IC $LD_{50}$ values all $>1.5 \times 10^5$ PFU and behaved like the parental WT virus, with only <20% of infected mice developing clinical symptoms and death at a maximum dose of $1.5 \times 10^5$ PFU/mouse (Table 6 and Table 7). In all dead or surviving mice, virus titration confirmed the presence ($1.4$-$3.5 \times 10^6$ PFU/brain) or absence, respectively, of productive viral replication in the brain tissues; as expected, all mock-infected mice survived with no signs of disease. Thus, these findings show that of the eight point mutations, a single $G^{1708A}$ substitution, replacing a Gly with Glu at amino acid residue 244 of the viral E glycoprotein, is sufficient to confer lethal neurovirulence in mice.

TABLE 6

Summary of the in vivo neurovirulence of $SA_{14}$-14-$2^{MCV}$ and its eight mutants.

| Virus | IC, $LD_{50}$ (PFU) | Neurovirulence |
|---|---|---|
| $SA_{14}$-14-$2^{MCV}$ (WT) | $>1.5 \times 10^5$ | Attenuated |
| $G^{317}A$ | $>1.5 \times 10^5$ | Attenuated |
| $U^{419}C$ | $>1.5 \times 10^5$ | Attenuated |
| $G^{1708}A$ | <1.5 | Neurovirulent |
| $U^{2580}C$ | $>1.5 \times 10^5$ | Attenuated |
| $C^{3215}U$ | $>1.5 \times 10^5$ | Attenuated |
| $C^{5987}U$ | $>1.5 \times 10^5$ | Attenuated |
| $G^{6551}A$ | $>1.5 \times 10^5$ | Attenuated |
| $U^{8588}C$ | $>1.5 \times 10^5$ | Attenuated |

Groups of 3-week-old ICR mice (n=10 per group) were inoculated IC with doses of the virus stock serially diluted 10-fold, and the $LD_{50}$ values were determined.

Figure 8:
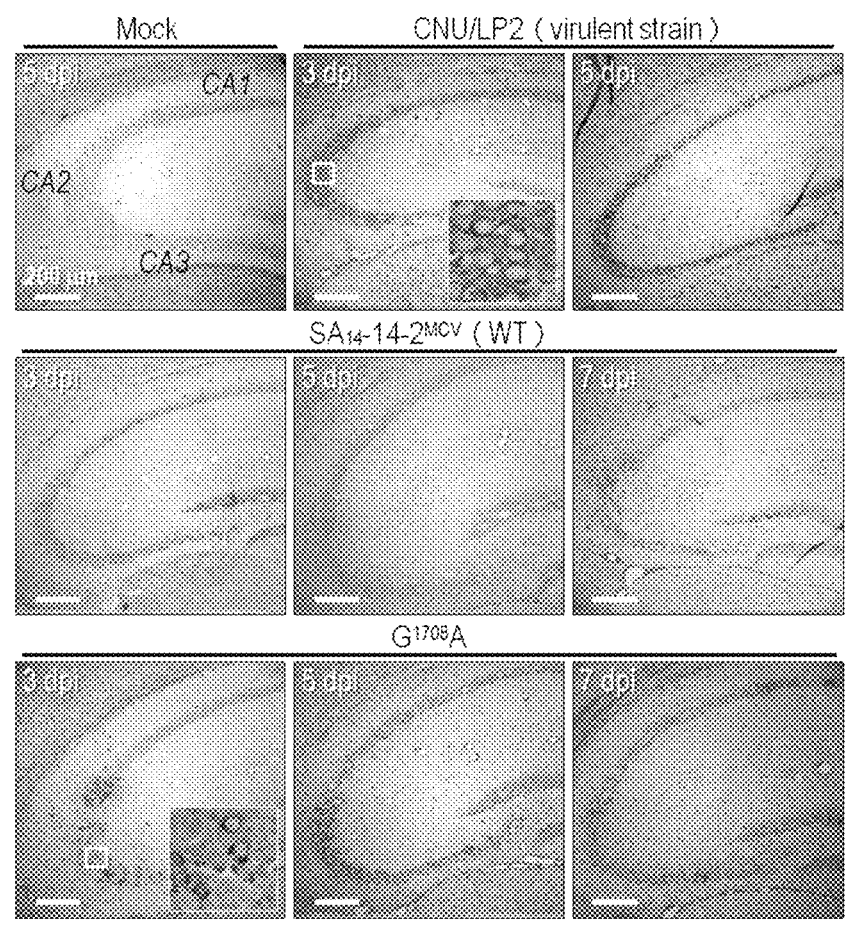
Figure 9:
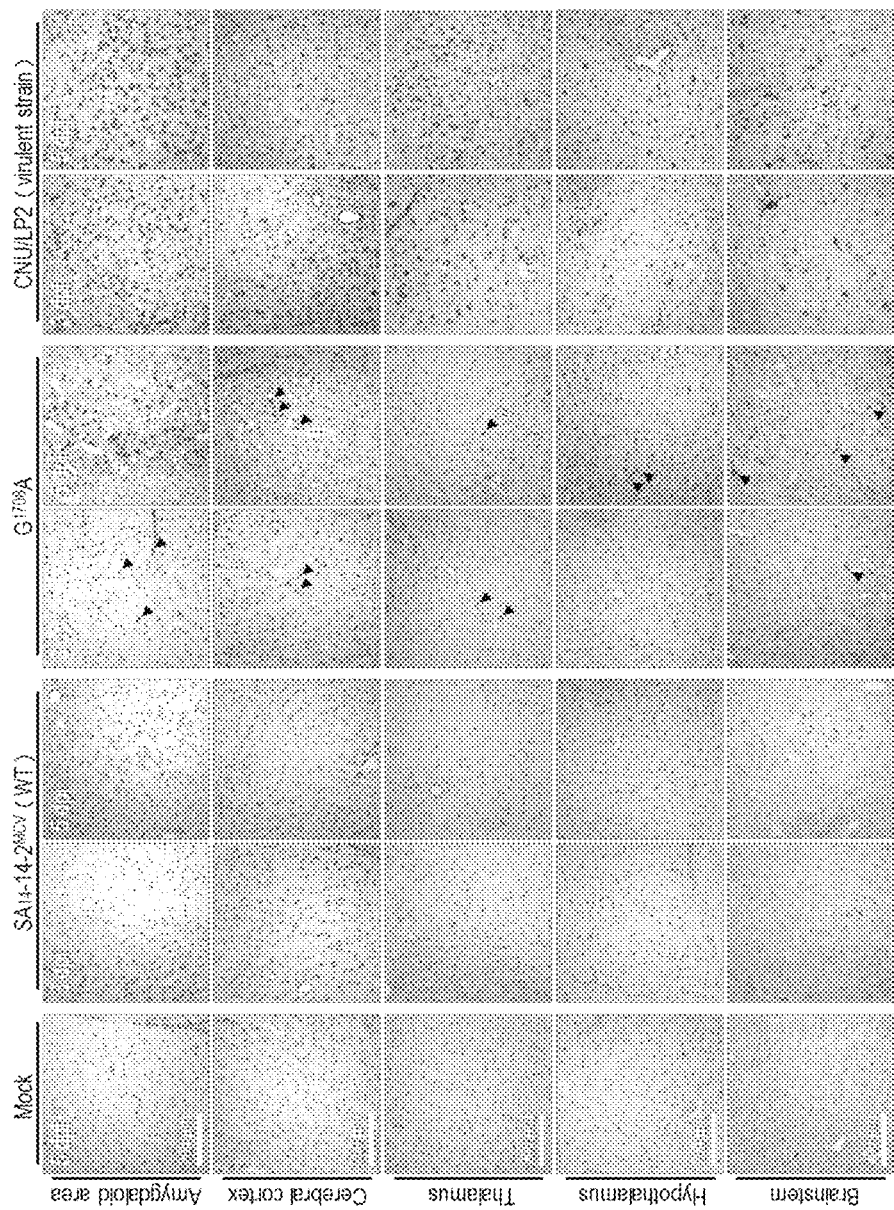
FIG. 9. A single point mutation promotes susceptibility to $SA_{14}$-14-2$^{MCV}$ infection of neurons in the CNS. Groups of 3-week-old female ICR mice (n=15 per group) were mock-infected or infected IC with $10^3$ PFU of $SA_{14}$-14-2$^{MCV}$ (WT), $G^{1708}A$, or CNU/LP2 (a virulent JEV strain used as a reference). On the indicated days after infection, five mice were subjected for immunostaining of JEV NS1 antigen in fixed brain slices with an α-NS1 antiserum. Presented are representative slides of amygdala, cerebral cortex, thalamus, hypothalamus, and brainstem (note that hippocampal slides are shown in FIG. 8). Arrowheads indicate the NS1-positive cells.

To determine whether the mutant $G^{1708}A$, unlike the parent $SA_{14}$-14-$2^{MCV}$ (WT), is able to replicate and spread in the CNS, immunohistochemistry techniques have been employed to stain for JEV NS1 antigen in mouse brains after IC inoculation (FIG. 8 shows hippocampal slides, and FIG. 9 presents slides of other brain areas, i.e., amygdala, cerebral cortex, thalamus, hypothalamus, and brainstem): (i) In brains infected with a virulent JEV CNU/LP2 (control), a large number of NS1-positive neurons were observed at 3 dpi in all areas we stained; this number was increased significantly at 5 dpi. In the hippocampus, most infected neurons were found in the CA2/3 region at 3 dpi and had spread to the CA1 region by 5 dpi. (ii) In brains infected with WT, almost no NS1-positive cells were found in any brain region during the entire 7-day course of the experiment. In a few atypical cases, a small number of NS1-positive neurons were noted at 5-7 dpi in the hippocampal CA2/3 region, but not the CA1 region. (iii) In brains infected with the mutant $G^{1708}A$, a considerable number of NS1-positive neurons were observed at 3 dpi, mainly in the hippocampal CA2/3 region, and only a few in other areas (amygdala, cerebral cortex, thalamus, and brainstem); overall, the number of infected neurons was much lower than in brains infected with JEV CNU/LP2. At 5-7 dpi, the number of NS1-positive neurons was noticeably increased in the hippocampus (now in the CA1) and amygdala, but not in other brain regions. These findings show that, in mice, a single $G^{1708}A$ substitution changing a Gly with Glu at position E-244 promotes susceptibility to $SA_{14}$-14-$2^{MCV}$ infection of neurons.

Figure 10:
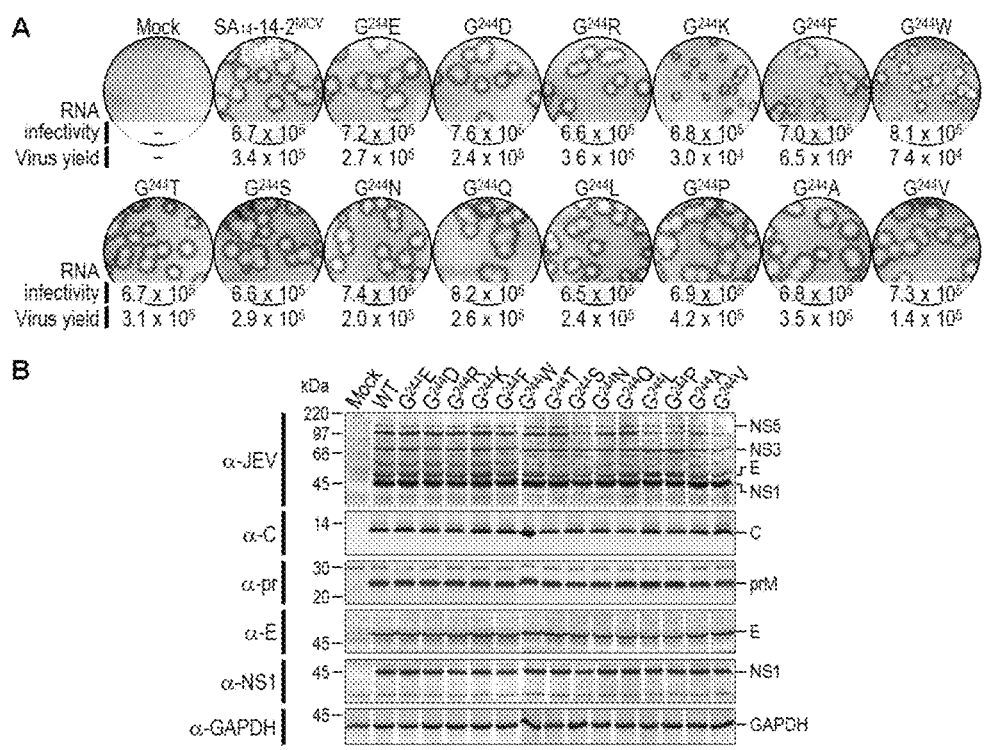
FIG. 10. In vitro replicability of $SA_{14}$-14-2$^{MCV}$ and its 14 E-244 mutants. BHK-21 cells were mock-transfected or transfected with RNAs transcribed from $SA_{14}$-14-2$^{MCV}$ (WT) or one of the 14 E-244 mutant cDNAs as indicated. RNA infectivity (in PFU/μg) at 4 days post-transfection was estimated by infectious center assay, coupled with staining of cell monolayers using an α-JEV antiserum, and virus yield (in PFU/ml) at 22 hours post-transfection (hpt) was determined by plaque titration (A). At 18 hpt, viral protein accumulation was analyzed by immunoblotting of cell lysates with a panel of JEV-specific antisera (B). In parallel, GAPDH protein was used as a loading and transfer control.
Figure 11:
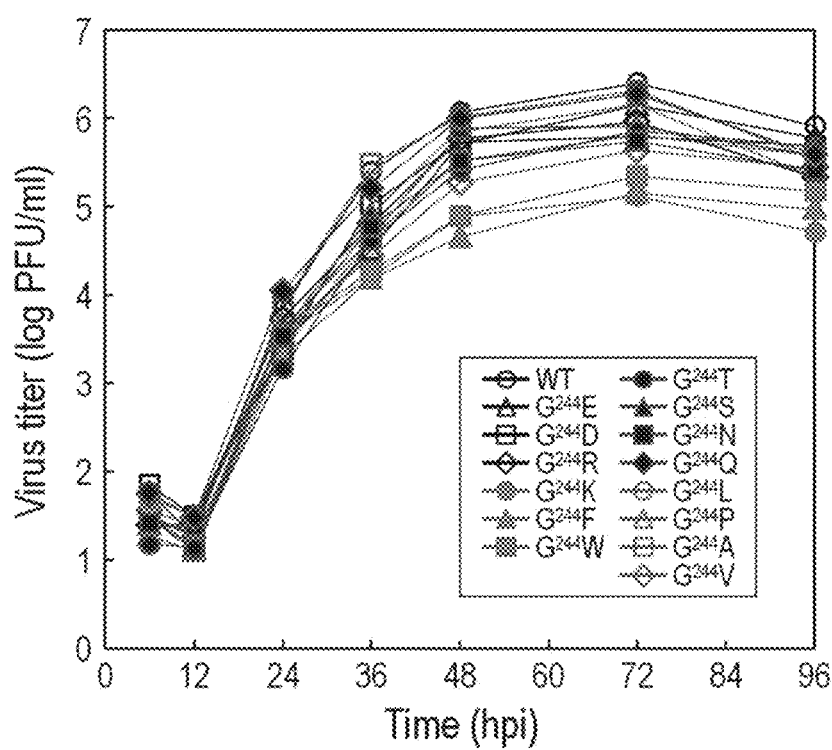
FIG. 11. Viral growth properties of $SA_{14}$-14-2$^{MCV}$ and its 14 E-244 mutants. BHK-21 cells were infected at an MOI of 0.1 with $SA_{14}$-14-2$^{MCV}$ (WT) or one of the 14 E-244 mutant viruses. At the indicated time points, culture supernatants were used for virus titration. hpi, hours post-infection.

Example 6. A Novel Regulatory Role in Neurovirulence of E-244, Located in the Ij Hairpin of the Viral E Glycoprotein To probe the functional importance of the amino acid side chain at position E-244 for the viral replication and neurovirulence of $SA_{14}$-14-$2^{MCV}$, site-directed mutagenesis was performed, replacing $G^{244}$ with 14 other amino acids of six different classes: (1) aliphatic A, V, and L; (2) hydroxyl S and T; (3) cyclic P; (4) aromatic F and W; (5) basic R and K; and (6) acidic and their amides D, E, N, and Q. First, the viability of synthetic RNAs transcribed in vitro from the corresponding mutant cDNAs was analyzed by measuring their infectivity after transfection of BHK-21 cells. In all cases, the mutant RNA was as viable as WT, with a specific infectivity of $6.5$-$8.2 \times 10^5$ PFU/µg (FIG. 10A, RNA infectivity). However, three mutants ($G^{244}K$, $G^{244}F$, and $G^{244}W$) were noticeably different from WT and the other 11 mutants, as demonstrated by a ~10-20-fold decrease in the yield of progeny virions released into culture medium during the first 22 hpt (FIG. 10A, Virus yield) and a ~2-2.5-fold reduction in the size of foci/plaques produced at 96 hpt (FIG. 10A, Focus/plaque morphology), although no significant difference was observed in the level of viral proteins (i.e., C, prM, E, and NS1) accumulated in RNA-transfected cells at 18 hpt (FIG. 10B). As compared to $G^{244}K$, the mutant $G^{244}R$ exhibited a barely marginal decrease in focus/plaque size and no detectable change in virus production (FIG. 10A). Overall, these findings were more evident when all mutant viruses were evaluated in multistep growth assays over the course of 96 hours after infection at an MOI of 0.1, assessing their ability to grow and establish a productive infection (FIG. 11). These findings indicate that the amino acid side chain at position E-244 has a variable impact on the production and spread of infectious virions in BHK-21 cells.

In mice, the neurovirulence of the 14 E-244 mutant viruses was determined by IC inoculating groups of 3-week-old ICR mice (n=10 per group) with various doses ranging from 1.5 to $1.5 \times 10^4$ or $10^5$ PFU/mouse of $SA_{14}$-14-$2^{MCV}$ (WT) or each mutant virus. According to their IC $LD_{50}$ values, the 14 E-244 mutant viruses are classified into three groups (Table 8 and Table 9): (i) group 1 (six mutants), neurovirulent, with an IC $LD_{50}$ of 1.5 to 31 PFU, exemplified by replacing $G^{244}$ with E, D, T, S, Q, and P; (ii) group 2 (six mutants), non-neurovirulent or neuroattenuated, with an IC $LD_{50}$ of $>1.5 \times 10^4$ or $10^5$ PFU, behaving like WT and exemplified by changing $G^{244}$ with R, K, F, W, N, and L; and (iii) group 3 (two mutants), with an intermediate phenotype and an IC $LD_{50}$ of $1.2$-$5.8 \times 10^3$ PFU, exemplified by substituting $G^{244}$ with A and V. The presence or absence of viral replication in the brain tissues of all dead or surviving mice was confirmed, respectively; all mock-infected mice survived with no signs of disease. Also, the mutation and phenotype relationship was corroborated by sequence analysis of recovered viruses from brain tissues of moribund or dead mice following IC inoculation (Table 10). All of the 14 mutants were analyzed, except for four group 2 mutants ($G^{244}R$, $G^{244}F$, $G^{244}W$, and $G^{244}L$), which failed to produce a lethal infection. In each case, the complete 2,001-nucleotide coding region of the prM and E genes was amplified from each of four randomly selected brain samples, followed by cloning and sequencing of at least seven independent clones per brain sample. In all six group 1 and two group 3 mutants, it was noted that the initial mutations introduced at the $G^{244}$ codon were maintained with no second-site mutations, consistent with the high and intermediate levels of their neurovirulent phenotype (Table 10). In the remaining two group 2 mutants ($G^{244}K$ and $G^{244}N$), however, a majority of the sequenced clones contained a point mutation in the same codon that led to an amino acid substitution (i.e., K→E/T and N→D, respectively), converting both mutants into neurovirulent viruses and highlighting the biological importance of the amino acid at position E-244 for neurovirulence (Table 10).

TABLE 8

Summary of the in vivo neurovirulence of $SA_{14}$-$2^{MCV}$ and its 14 E-244 mutants.

| Virus | IC, $LD_{50}$ (PFU) | Neurovirulence |
| --- | --- | --- |
| $SA_{14}$-14-$2^{MCV}$ (WT) | $>1.5 \times 10^5$ | Attenuated |
| $G^{244}E$ | <1.5 | Neurovirulent |
| $G^{244}D$ | 1.5 | Neurovirulent |
| $G^{244}R$ | $>1.5 \times 10^4$ | Attenuated |
| $G^{244}K$ | $>1.5 \times 10^4$ | Attenuated |
| $G^{244}F$ | $>1.5 \times 10^4$ | Attenuated |
| $G^{244}W$ | $>1.5 \times 10^4$ | Attenuated |
| $G^{244}T$ | <1.5 | Neurovirulent |
| $G^{244}S$ | $3.1 \times 10^1$ | Neurovirulent |
| $G^{244}N$ | $>1.5 \times 10^5$ | Attenuated |
| $G^{244}Q$ | 1.5 | Neurovirulent |
| $G^{244}L$ | $>1.5 \times 10^5$ | Attenuated |
| $G^{244}P$ | <1.5 | Neurovirulent |
| $G^{244}A$ | $5.8 \times 10^3$ | Intermediate |
| $G^{244}V$ | $1.2 \times 10^3$ | Intermediate |

Groups of 3-week-old ICR mice (n=10 per group) were infected IC with serial 10-fold dilutions of each virus stock, and the $LD_{50}$ values were determined.

Figure 12:
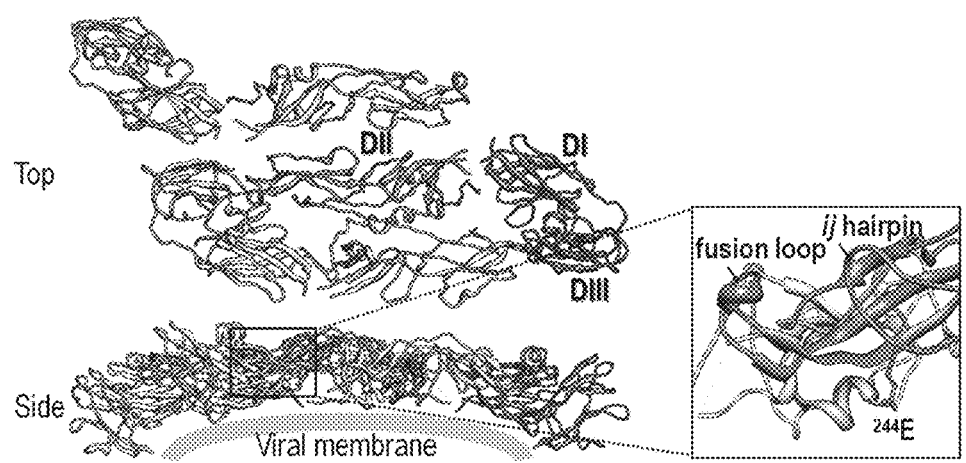
FIG. 12. E-244: a key neurovirulence factor located in the ij hairpin of the viral E glycoprotein. The predicted model of the E ectodomain of JEV $SA_{14}$-14-2 was built based on the crystal structure of the E ectodomain of WNV NY99, and the model was then fitted into the cryo-electron microscopy structure of WNV NY99. Illustrated is an icosahedral asymmetric unit of the three E monomers on the viral membrane. Highlighted in the inset is the critical residue Glu at E-244 (244E) in the ij hairpin adjacent to the fusion loop of the viral E DII. DI, domain I; DII, domain II; DIII, domain III.
Figure 13:
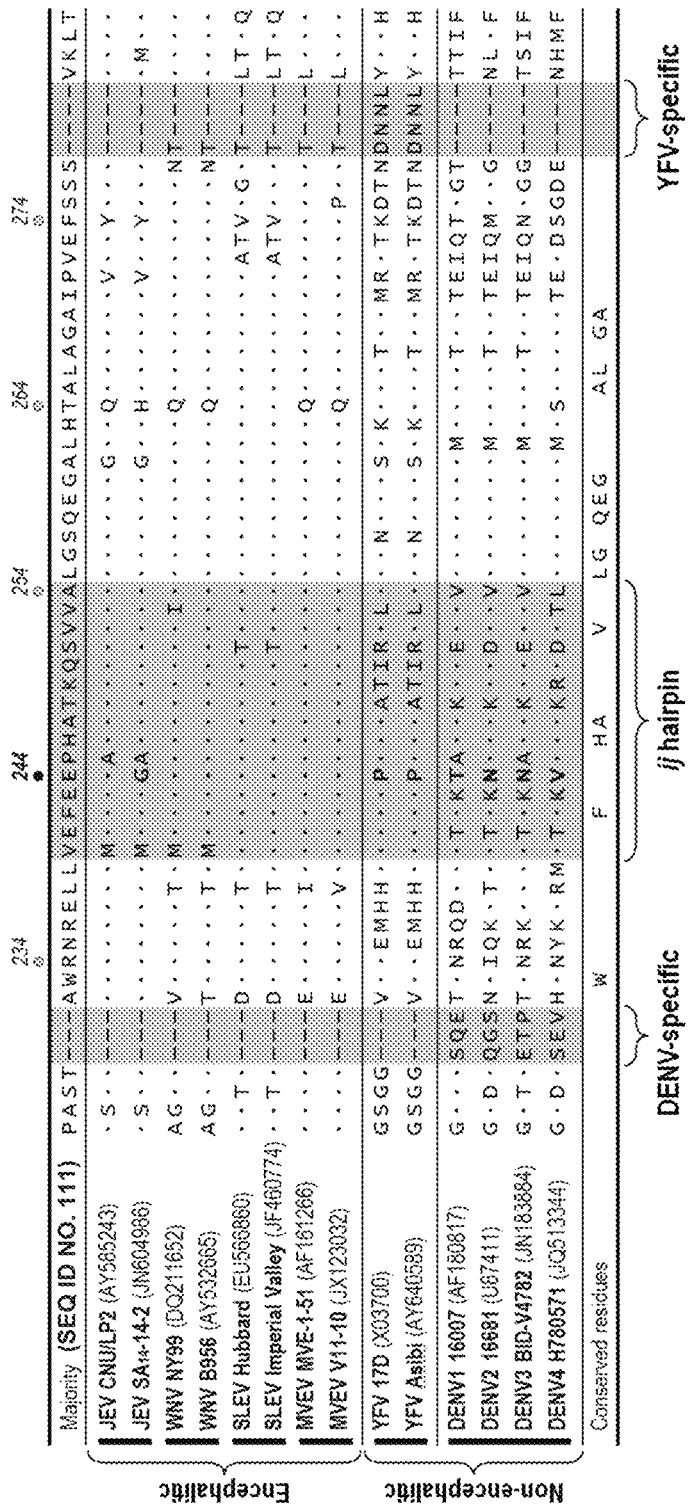
FIG. 13. Structure-based, ij-hairpin amino acid sequence alignment for six representative flaviviruses (14 strains total): JEV, WNV, SLEV, MVEV, YFV, and dengue virus (DENV). All sequence information was retrieved from the GenBank database with accession numbers indicated. Multiple sequence alignments were performed using ClustalX. Highlighted are the ~25-aa ij-hairpin, the 3-aa DENV-specific motif, and the 4-aa YFV-specific motif. The consensus sequence of the ij hairpin and its flanking region is presented on top (SEQ ID NO:111), and only differences from that sequence are shown. Deletions are indicated by hyphens. Identical residues are indicated by dots. The amino acid residue is numbered based on the JEV $SA_{14}$-14-2 (GenBank accession no. JN604986).

Homology modeling was performed to gain insight into the structural basis of E-244 function. The 3D model of the E monomer of JEV $SA_{14}$-14-2 was constructed using the 3.0-Å crystal structure of the E monomer of WNV NY99 as a template, with 75.5% sequence identity. The model was then fitted into the outer layer of the cryo-electron microscopy (EM) structure of WNV NY99, thereby visualizing three monomers placed into an icosahedral asymmetric unit on the viral membrane. In each E monomer of $SA_{14}$-14-2 containing three domains (DI, DII, and DIII), it was noted that E-244 lies within the ij hairpin adjacent to the fusion loop at the tip of DII, with its amino acid side chain pointing toward the viral membrane (FIG. 12). Next, the structure-based, ij-hairpin amino acid sequence alignment was performed with six representative flaviviruses (14 strains total), including four encephalitic (JEV, WNV, SLEV, and MVEV) and two non-encephalitic (YFV and DENV) flaviviruses. In addition to the importance of the E-244 amino acid, three significant findings were noted: (i) the evolutionarily conserved residues in the ij hairpin and its flanking region in all six flaviviruses, i.e., $W^{233}$, $F^{242}$, $H^{246}$, $A^{247}$, $V^{252}$ $L^{255}$, $G^{256}$, $Q^{258}$, $E^{259}$, and $G^{260}$; (ii) the sequence similarities in the four encephalitic flaviviruses, particularly in a ~25-aa-hairpin-containing region; and (iii) the sequence differences between the four encephalitic and two non-encephalitic flaviviruses, e.g., the 4-aa YFV-specific motif and the 3-aa DENV-specific motif (FIG. 13). These findings suggest that the ij hairpin of the E DII plays a key role in determining encephalitic *flavivirus* neurovirulence, and its function is regulated by the chemical property of the amino acid at position E-244 in that hairpin.

Example 7. The Ij Hairpin as a New Antiviral Drug Target

In embodiments, the present disclosure provides the methods of identifying a candidate antiviral drug agent that can inhibit *flavivirus* infection/replication, by targeting the structure or function of the ij hairpin. The conservation of the ij hairpin discussed in the present disclosure demonstrates that candidate drug agents targeting the ij hairpin may be screened against JEV and other closely related flaviviruses. Antibodies, peptides, or small molecules may target the ij hairpin. Antibodies may block the functional role of the ij hairpin, thereby inhibiting one of several critical steps in viral infection/replication. Synthetic peptides corresponding to the ij hairpin may disrupt the function of the viral ij hairpin. Synthetic peptides may be generated by methods known in the art. For example, 20-aa peptides corresponding to an ij hairpin (E-241 to G-260, FIG. 13) may be used to (i) block viral infection/replication, or (ii) to generate polyclonal or monoclonal antibodies, capable of selectively binding the ij hairpin. Without limiting the invention, the peptides may have Ala or Pro at position 245 of JEV E glycoprotein. Antibodies may be generated by any means known in the art. For example, mice may be immunized with a 20-aa synthetic peptide corresponding to the ij hairpin (E-241 to G-260). Alternatively, the peptide may have Ala or Pro at position 245 of the viral E glycoprotein. The synthetic peptides may be conjugated at their N-termini to a hapten carrier, to produce polyclonal and monoclonal antibodies. ELISA may be employed to test the selective binding of the antibodies, as compared to antibodies from similar peptides without the hapten carrier.

Candidate antiviral drugs may be screened using a cell-based assay. For example, a standard plaque reduction assay and an immunofluorescence- or flow cytometry-based infectivity reduction assay may be employed in the screening of candidate antivirals. A non-specific antibody or scrambled peptide may be used as a negative control, as appropriate. Generally, the 50% inhibition titer/concentration may be determined. In embodiments, a recombinant *flavivirus* encoding a reporter gene (e.g., green fluorescent protein and luciferase) may facilitate antiviral drug screening, with the expression of a particular reporter gene being monitored as an indication of viral infection/replication. Reporter-expressing recombinant flaviviruses may be constructed by means known in the art.

Example 8. Nucleotide Sequences

Several nucleotide sequences useful in carrying out various embodiments of the invention are disclosed herein. SEQ ID NO:1 is the nucleotide sequence of the cDNA corresponding to the genomic RNA of JEV $SA_{14}$-14-2 (a total of 10,977 nucleotides). SEQ ID NO:2 is the nucleotide sequence of the full-length infectious $SA_{14}$-14-2 cDNA molecular clone (a total of 18,574 nucleotides).

Example 9. Discussion

In embodiments, the present disclosure provides a reverse genetics system for $SA_{14}$-14-2, a live-attenuated JE vaccine, by constructing a full-length infectious cDNA and rescuing molecularly cloned virus from the cDNA. This reverse genetics system offers us a unique opportunity to elucidate the genetic and molecular basis of JEV neurovirulence. Using the infectious $SA_{14}$-14-2 cDNA, the present disclosure shows (1) the generation of three isogenic $SA_{14}$-14-2 variants, unlike its parent, displaying lethal neurovirulence in mice; (ii) the identification of a single point mutation, $G^{1708} \rightarrow A$, causing a Gly→Glu change at position 244 of the viral E glycoprotein that is sufficient to confer a full neurovirulence by promoting viral infection into neurons in the mouse CNS; and (iii) the demonstration of the structure-function relationship for neurovirulence of E-244 in the ij hairpin adjacent to the fusion loop at the tip of the viral E DII. Thus, the findings of the present disclosure reveal fundamental insights into the neurotropism and neurovirulence of JEV and other taxonomically related encephalitic flaviviruses, including WNV, SLEV, and MVEV. In addition, the present disclosure also provides a new target, the ij hairpin, for the development of novel antivirals for the prevention and treatment of infection with the encephalitic flaviviruses.

The *flavivirus* glycoprotein E, which is responsible for viral entry, mediates receptor-mediated endocytosis and low pH-triggered membrane fusion. On the viral membrane, 180 E monomers are packed into 30 protein "rafts," each composed of three E head-to-tail homodimers. Each E monomer is composed of three parts: (i) an elongated ectodomain that directs receptor binding and membrane fusion; (ii) a "stem" region containing two amphipathic α-helices that lies flat on the viral membrane underneath the ectodomain; and (iii) a membrane "anchor" region containing two transmembrane antiparallel coiled-coils. The E ectodomain folds into three ß-barrel domains: (i) DI, a structural domain centrally located in the molecule; (ii) DII, an elongated dimerization domain containing the highly conserved fusion loop at its tip; and (iii) DIII, an Ig-like domain implicated in receptor binding and antibody neutralization. Based on pre- and post-fusion crystal structures of the ectodomain and biochemical analyses, a current, detailed model for *flavivirus* membrane fusion has been developed. In this model, the fusion is initiated by a low pH-induced dissociation of the antiparallel E homodimers that leads to the exposure of the fusion loops and their insertion into the host membrane, followed by a large-scale structural rearrangement into a parallel E homotrimer. In the parallel conformation, DIII folds back toward DII, presumably with the stem extended from the C-terminus of DIII along DII and toward the fusion loop ("zipping"), driving the fusion of the viral and host membranes.

In flaviviruses, the ij hairpin is a structural motif that is closely associated with the fusion loop at the tip of the viral E DII, but its role is thus far unknown. In JEV, the present disclosure demonstrates that a single amino acid in the ij hairpin, E-244, serves as a key regulator to control the level of neurovirulence of $SA_{14}$-14-2 in mice. This amino acid was also correlated with a differential ability to infect neurons, the primary target cells in the CNS. Consistent with this finding, it was discovered that site-directed mutagenesis of the codon for E-244 in $SA_{14}$-14-2 created a panel of 14 recombinant viruses of varying neurovirulence: (i) non-neurovirulent/neuroattenuated viruses, produced by substitutions of positively-charged (R, K), aromatic (F, W), polar (N), or aliphatic (L) residues; (ii) neurovirulent viruses, produced by substitutions of negatively-charged (E, D), hydroxyl (T, S), polar (Q), or cyclic (P) residues; and (iii) viruses intermediate in neurovirulence, produced by substitutions of aliphatic (A, V) residues. These results highlight the role of E-244 in neurovirulence, which was directed by a combination of three major properties of its amino acid side chain: (i) charge (R/K vs. E/D); (ii) size (N vs. Q and L vs. A/V); and (iii) functional group (N vs. D). These data suggest that the ij hairpin acts as a viral factor that promotes JEV infection of neurons within the CNS, most likely through its role in one of three major steps involved in viral entry: binding, endocytosis, or membrane fusion. Also, it is conceivable that late steps of the virus life cycle in neurons such as assembly, maturation and release could be affected.

There is little available structural information about how flaviviruses bind to their cellular receptors. In encephalitic flaviviruses, the presence of an RGD motif in DIII and carbohydrate moieties on the viral surface suggests a mechanism involving interaction with the RGD motif-recognizing integrins and sugar-binding lectins on the cell surface, respectively. However, blocking/alteration of either the RGD motif or glycan does not abolish viral entry. Thus, the viral factors and the interacting cellular counterparts required for viral entry are still elusive. For JEV and other flaviviruses, highly sulfated negatively charged glycosaminoglycans (e.g., heparan sulfates) can be utilized as initial low-affinity attachment factors for concentrating virus particles on the cell surface, a process that might lead to subsequent interaction with other receptor molecules. Several cellular proteins have been proposed as putative attachment molecules for JEV: (i) $α_v β_3$ integrin from Vero cells, (ii) a C-type lectin mannose receptor (MR) from macrophages, (iii) HSP70 from Neuro-2a cells, and (iv) vimentin from N18 and HTB-11 cells. For other flaviviruses, three of the most extensively studied attachment factors are the C-type lectins, namely DC-SIGN, DC-SIGNR, and MR, which interact with carbohydrate moieties with different sugar specificities on the viral E glycoprotein. Other molecules that have been implicated in assisting *flavivirus* entry include CD14-associated molecules, high-affinity laminin receptor, Rab5 GTPase, HSP70/90, ubiquitin ligase CBLL1, and TIM/TAM receptors involved in apoptotic cell recognition and clearance.

In embodiments, the present disclosure demonstrates that E-244 in the ij hairpin of the viral E DII is a key regulator determining the neurovirulence of $SA_{14}$-14-2, and shows that viral E can contribute to the neurovirulence of JEV and other closely related encephalitic flaviviruses via its role in viral infection into neurons. A detailed, complete understanding of the evolutionarily conserved viral ij hairpin and its function in viral infection/replication will have direct application to the design of a novel and promising class of broad-spectrum antivirals (e.g., ligands and small molecules) to expand the currently available preventive and therapeutic arsenal against infection with encephalitic flaviviruses.

Example 10. Materials and Methods for Examples 1-9

Viruses and Cells.

An original stock of JEV SA$_{14}$-14-2 was prepared by collecting from a batch of commercial vaccine vials for viral genome sequencing; the virus stock was propagated twice in BHK-21 cells to generate high-titer viral preparations for cell and mouse infection experiments. Stocks of JEV CNU/LP2 were derived from the infectious cDNA pBAC$^{SP6}$/JVFLx/XbaI. BHK-21 cells were grown in α-MEM containing 10% fetal bovine serum (FBS), 2 mM L-glutamine, vitamins, and antibiotics at 37° C. in 5% $CO_2$.

JEV Reverse Genetics.

As a vector, the BAC plasmid pBeloBAC11 was used. First, four cDNA fragments covering the entire viral genome were cloned into the vector individually, then joined sequentially at three natural restriction sites (BsrGI, BamHI, and AvaI) to generate a single BAC clone that contained the full-length SA$_{14}$-14-2 cDNA, named pBAC/SA$_{14}$-14-2 (FIG. 1). The SP6 promoter sequence was positioned just upstream of the viral 5'-end, and an artificial XbaI run-off site was engineered just downstream of the viral 3'-end. A pre-existing XbaI site at nucleotide 9131 was removed by introducing a silent point mutation ($A^{9134} \to T$); this mutation also served as a rescue marker to identify the cDNA-derived SA$_{14}$-14-2. All mutations were created by overlap extension PCR. All PCR-generated fragments were sequenced.

Construction of a Full-Length Infectious cDNA of SA$_{14}$-14-2.

All plasmids were constructed by standard recombinant DNA techniques. The oligonucleotides used in the present invention are listed in Table 11. Using the SA$_{14}$-14-2 genomic RNA as a template, a contig of four cDNA fragments (Frag-I to IV) was first synthesized by RT-PCR using the following primers: Frag-I (2573 bp), JS1rt and JS1fw+JS1rv; Frag-II (4171 bp), JS2rt and JS2fw+JS2rv; Frag-III (3922 bp), JS3rt and JS3fw+JS3rv; and Frag-IV (1798 bp), JS4rt and JS4fw+JS4rv. The four overlapping cDNAs were individually subcloned into pBAC/PRRSV/FL, a derivative of the pBeloBAC11 plasmid, by ligating the 15426-bp PmeI-NotI fragment of pBAC/PRRSV/FL with the 2559-, 4157-, 3908-, and 1784-bp SmaI-NotI fragments of the Frag-I to IV amplicons, respectively. This created pBAC/Frag-I to IV.

To introduce the SP6 promoter immediately upstream of the 5'-end of the full-length SA$_{14}$-14-2 cDNA, the pBAC/Frag-I was modified. Two DNA fragments were first amplified by (i) PCR of pBAC$^{SP6}$/JVFLx/XbaI with primers JSsp6fw+JSsp6rv (JSsp6rv incorporates the antisense sequence of the SP6 promoter) and (ii) PCR of pBAC/Frag-I with primers JSFrag1fw+JSFrag1rv. These two fragments were then fused by a second round of PCR with primers JSsp6fw+JSFrag1rv. The 760-bp PacI-BsiWI fragment of the fused PCR amplicons was ligated with the 9532-bp PacI-BsiWI fragment of pBAC/Frag-I. This generated pBAC/Frag-I$^{SP6}$.

To engineer an artificial XbaI run-off site immediately downstream of the 3'-end of the full-length SA$_{14}$-14-2 cDNA, the pre-existing, internal XbaI site at position 9131 in the NS5 protein-coding region was first removed by introducing a silent point mutation, $A^{9134} \to T$. Thus, two DNA fragments were generated by PCR of pBAC/Frag-III with two pairs of primers, JSX1fw+JSX1rv and JSX2fw+JSX2rv. These two fragments were then fused by a second round of PCR with primers JSX1fw+JSX2rv. The 949-bp AvrII-Not1 fragment of the fused amplicons was ligated with the 16245-bp NotI-BsiWI and 2141-bp BsiWI-AvrII fragments of pBAC/Frag-III to produce pBAC/Frag-III$^{KO}$. Then, a new XbaI run-off site was introduced by site-directed mutagenesis. A DNA fragment was amplified by PCR of pBAC/Frag-IV with primers JSROfw+JSROry (JS-ROry incorporates the antisense sequence of XbaI and NotI recognition sites in a row). The 283-bp SfiI-NotI fragment of the resulting amplicons was ligated with the 16933-bp SfiI-NotI fragment of pBAC/Frag-IV to create pBAC/Frag-IV$^{RO}$.

Thus far, a set of four final subclones were constructed: pBAC/Frag-I$^{SP6}$, pBAC/Frag-II, pBAC/Frag-III$^{KO}$, and pBAC/Frag-IV$^{RO}$. As illustrated in FIG. 1, the full-length SA$_{14}$-14-2 cDNA (designated pBAC/SA$_{14}$-14-2) was assembled by joining the 7456-bp NotI-PacI fragment of pBAC$^{SP6}$/JVFLx/XbaI with the following four fragments in a sequential manner: (i) the 2022-bp PacI-BsrGI fragment of pBAC/Frag-I$^{SP6}$, (ii) the 3689-bp BsrGI-BamHI fragment of pBAC/Frag-II, (iii) the 3800-bp BamHI-AvaI fragment of pBAC/Frag-III$^{KO}$, and (iv) the 1607-bp AvaI-NotI fragment of pBAC/Frag-IV$^{RO}$.

TABLE 11

Oligonucleotides used for ligation, cDNA synthesis, and PCR amplification.

| Oligo-nucleotide | Sequence$^a$ (5'→3') | SEQ ID NO: | Polarity |
|---|---|---|---|
| JS1rt | TAGGGATCTGGGCGTTTCTGGCAAAT | 35 | Antisense |
| JS1fw | aatcccgggAGAAGTTTATCTGTGTGAACTT | 36 | Sense |
| JS1rv | attgcggccgcCCACGTCGTTGTGCACGAAGAT | 37 | Antisense |
| JS2rt | TTCTGCCTACTCTGCCCCTCCGTTGA | 38 | Antisense |
| JS2fw | aatcccgggTCAAGCTCAGTGATGTTAACAT | 39 | Sense |
| JS2rv | attgcggccgcGATGGGTTTCCGAGGATGACTC | 40 | Antisense |

TABLE 11-continued

Oligonucleotides used for ligation, cDNA synthesis, and PCR amplification.

| Oligo-nucleotide | Sequence$^a$ (5'→3') | SEQ ID NO: | Polarity |
|---|---|---|---|
| JS3rt | ACGGTCTTTCCTTCTGCTGCAGGTCT | 41 | Antisense |
| JS3fw | aatcccgggGAGGATACATTGCTACCAAGGT | 42 | Sense |
| JS3rv | attgcggccgcGTAAGTCAGTTCAATTATGGCT | 43 | Antisense |
| JS4rt | AGATCCTGTGTTCTTCCTCACCACCA | 44 | Antisense |
| JS4fw | aatcccgggAGTGGAAGGCTCAGGCGTCCAA | 45 | Sense |
| JS4rv | attgcggccgcAGATCCTGTGTTCTTCCTCACC | 46 | Antisense |
| JSsp6fw | cataccccgcgtattcccacta | 47 | Sense |
| JSsp6rv | ACAGATAAACTTCTctatagtgtcccctaaa | 48 | Antisense |
| JSFrag1fw | aggggacactatagAGAAGTTTATCTGTGTG | 49 | Sense |
| JSFrag1rv | TGGATCATTGCCCATGGTAAGCTTA | 50 | Antisense |
| JSX1fw | CGAATGGATCGCACAGTGTGGAGAG | 51 | Sense |
| JSX1rv | AAAGCTTCAAACTCAAGATACCGTGCTCC | 52 | Antisense |
| JSX2fw | GGAGCACGGTATCTTGAGTTTGAAGCTTT | 53 | Sense |
| JSX2rv | cacgtggacgagggcatgcctgcag | 54 | Antisense |
| JSROfw | CCAGGAGGACTGGGTTACCAAAGCC | 55 | Sense |
| JSROrv | agggcggccgctctagAGATCCTGTGTTCTTCCTCACCAC | 56 | Antisense |
| 317-1rv | TTCATTGCCACACTTTTTTCCACTGCTTT | 57 | Antisense |
| 317-2fw | AAAGCAGTGGAAAAAAGTGTGGCAATGAA | 58 | Sense |
| 419-1rv | ATGATTGAGCCTTCGTTTCCTCCTCTTTT | 59 | Antisense |
| 419-2fw | AAAAGAGGAGGAAACGAAGGCTCAATCAT | 60 | Sense |
| 1708-1fw | ACATTGGACGTCCGCATGATTAACA | 61 | Sense |
| 1708-1rv | TTGTGGCGTGCGCCTCTTCAAATTCCATG | 62 | Antisense |
| 1708-2fw | CATGGAATTTGAAGAGGCGCACGCCACAA | 63 | Sense |
| 1708-2rv | GATTTTTCGCGAACGAGAATTTTTC | 64 | Antisense |
| JSBsrG1w | CTGGCTCTGAAAGGCACAACCTATG | 65 | Sense |
| 2580-1rv | GGGCGTTTCTGGCAGATATTTATACCTAT | 66 | Antisense |
| 2580-2fw | ATAGGTATAAATATCTGCCAGAAACGCCC | 67 | Sense |
| JSBamHIrv | TCATGGATTGGGGCATTTGAGTCAG | 68 | Antisense |
| 3215-1rv | TTTGGTCCGGCTATAGTGTGCGGAATGAT | 69 | Antisense |
| 3215-2fw | ATCATTCCGCACACTATAGCCGGACCAAA | 70 | Sense |
| JSBamHIfw | CTTTATGACAGCGACCCCGCCTGGA | 71 | Sense |
| 5987-1rv | TTTCTGCCTACTCTACCCCTCCGTTGAGC | 72 | Antisense |
| 5987-2fw | GCTCAACGGAGGGGTAGAGTAGGCAGAAA | 73 | Sense |
| 5987-2rv | TACCTCGGTGTTGTCCTCCAGTATG | 74 | Antisense |
| 6551-1rv | TCAGCCGTTGCAACTAAGTACATGGTGTC | 75 | Antisense |
| 6551-2fw | GACACCATGTACTTAGTTGCAACGGCTGA | 76 | Sense |

TABLE 11-continued

Oligonucleotides used for ligation, cDNA synthesis, and PCR amplification.

| Oligo-nucleotide | Sequence[a] (5'→3') | SEQ ID NO: | Polarity |
|---|---|---|---|
| 6551-2rv | AATAATGAGCCAGCTTGTGAGTTAA | 77 | Antisense |
| 8588-1fw | AAGTCCAGAAGTAGAAGAACAACGC | 78 | Sense |
| 8588-1rv | CCGTGGTATGTCCAGGTGCGGTATGGATG | 79 | Antisense |
| 8588-2fw | CATCCATACCGCACCTGGACATACCACGG | 80 | Sense |
| 8588-2rv | CTATTGCATCCTAGACGAGGCTTGG | 81 | Antisense |
| DF | TGGAATTTGAAGACGCGCACGCCACA | 82 | Sense |
| DR | TGTGGCGTGCGCGTCTTCAAATTCCA | 83 | Antisense |
| AF | TGGAATTTGAAGCCGCGCACGCCACA | 84 | Sense |
| AR | TGTGGCGTGCGCGGCTTCAAATTCCA | 85 | Antisense |
| LF | ATGGAATTTGAACTGGCGCACGCCAC | 86 | Sense |
| LR | GTGGCGTGCGCCAGTTCAAATTCCAT | 87 | Antisense |
| PF | ATGGAATTTGAACCGGCGCACGCCAC | 88 | Sense |
| PR | GTGGCGTGCGCCGGTTCAAATTCCAT | 89 | Antisense |
| VF | TGGAATTTGAAGTCGCGCACGCCACA | 90 | Sense |
| VR | TGTGGCGTGCGCGACTTCAAATTCCA | 91 | Antisense |
| KF | ATGGAATTTGAAAAGGCGCACGCCAC | 92 | Sense |
| KR | GTGGCGTGCGCCTTTTCAAATTCCAT | 93 | Antisense |
| RF | ATGGAATTTGAAAGAGCGCACGCCACA | 94 | Sense |
| RR | TGTGGCGTGCGCTCTTTCAAATTCCAT | 95 | Antisense |
| FF | ATGGAATTTGAATTCGCGCACGCCACA | 96 | Sense |
| FR | TGTGGCGTGCGCGAATTCAAATTCCAT | 97 | Antisense |
| WF | ATGGAATTTGAATGGGCGCACGCCAC | 98 | Sense |
| WR | GTGGCGTGCGCCCATTCAAATTCCAT | 99 | Antisense |
| SF | ATGGAATTTGAAAGCGCGCACGCCACA | 100 | Sense |
| SR | TGTGGCGTGCGCGCTTTCAAATTCCAT | 101 | Antisense |
| TF | ATGGAATTTGAAACGGCGCACGCCAC | 102 | Sense |
| TR | GTGGCGTGCGCCGTTTCAAATTCCAT | 103 | Antisense |
| NF | ATGGAATTTGAAAACGCGCACGCCACA | 104 | Sense |
| NR | TGTGGCGTGCGCGTTTTCAAATTCCAT | 105 | Antisense |
| OF | ATGGAATTTGAACAGGCGCACGCCAC | 106 | Sense |
| OR | GTGGCGTGCGCCTGTTCAAATTCCAT | 107 | Antisense |
| prMErt | ATTTATACCTATCCACCCAGGCTTCC | 108 | Antisense |

TABLE 11-continued

Oligonucleotides used for ligation, cDNA synthesis, and PCR amplification.

| Oligo-nucleotide | Sequence$^a$ (5'→3') | SEQ ID NO: | Polarity |
|---|---|---|---|
| prMEfw | aatctcgagAGTTGTCATAGCTTGTGCAGG | 109 | Sense |
| prMErv | attccgcggTGATGTCAATGGCACATCCAG | 110 | Antisense |

$^a$ indicated JEV-specific sequences are shown in capital letters.

Mutagenesis of the Full-Length Infectious $SA_{14}$-14-2 cDNA.

Two panels of $SA_{14}$-14-2 mutants were constructed by overlap extension PCR mutagenesis. In all cases, pBAC/$SA_{14}$-14-2 was used as an initial template for PCR.

(i) 8 Pseudoreversion Mutants ($G^{317}A$, $U^{419}C$, $G^{1708}A$, $U^{2580}C$, $C^{3215}U$, $C^{5987}U$, $G^{6551}A$, and $U^{8588}C$):

For the $G^{317}A$ and $U^{419}C$ mutants, two overlapping fragments were first amplified by PCR with two pairs of primers, JSsp6fw+317-1rv/317-2fw+JSFrag1rv and JSsp6fw+419-1rv/419-2fw+JSFrag1rv, respectively. In both cases, the two synthesized fragments were fused by a second round of PCR with primers JSsp6fw and JSFrag1rv, and the 760-bp PacI-BsiWI fragment of the resulting amplicons was ligated with the 4951-bp BsiWI-BamHI and 12863-bp BamHI-PacI fragments of pBAC/$SA_{14}$-14-2. For the $G^{1708}A$ mutant, the first two fragments were produced by PCR with the following two primer pairs: 1708-1fw+1708-1rv/1708-2fw+1708-2rv. These two fragments were then fused by a second round of PCR with primers 1708-1fw and 1708-2rv. The 762-bp NheI-BsrGI fragment of the fused amplicons was ligated with the 9096-bp BsrGI-NotI and 8716-bp NotI-NheI fragments of pBAC/$SA_{14}$-14-2. For the $U^{2580}C$ and $C^{3215}U$ mutants, two overlapping fragments were first synthesized by PCR with two pairs of primers, namely JSBsrG1fw+2580-1rv/2580-2fw+JSBamH1rv and JSBsrG1fw+3215-1rv/3215-2fw+JSBamH1rv, respectively. In each case, the two fragments were fused by a second round of PCR with the JSBsrG1fw and JSBamH1rv primers. The 3689-bp BsrGI-BamHI fragment of the resulting amplicons was ligated with the 9489-bp BamHI-KpnI and 5396-bp KpnI-BsrGI fragments of pBAC/$SA_{14}$-14-2. For the $C^{5987}U$ mutant, the first two fragments were amplified by PCR with the following two primer pairs: JSBamH1fw+5987-1rv/5987-2fw+5987-2rv. These two fragments were fused by a second round of PCR with primers JSBamH1fw and 5987-2rv. The 736-bp BamHI-BsiWI fragment of the resulting amplicons was ligated with the 12127-bp BsiWI-PacI and 5711-bp PacI-BamHI fragments of pBAC/$SA_{14}$-14-2. For the $G^{6551}A$ mutant, two overlapping fragments were first generated by PCR with two pairs of primers, JSBamH1fw+6551-1rv/6551-2fw+6551-2rv, and subsequently fused by a second round of PCR with primers JSBamH1fw+6551-2rv. The 1539-bp BamHI-NheI fragment of the fused amplicons was ligated with the 11324-bp NheI-PacI and 5711-bp PacI-BamHI fragments of pBAC/$SA_{14}$-14-2. For the $U^{8588}C$ mutant, the first two overlapping fragments were produced by PCR with two pairs of primers, 8588-1fw+8588-1rv/8588-2fw+8588-2rv, and then fused by a second round of PCR with primers 8588-1fw+8588-2rv. The 2538-bp MluI-SfiI fragment of the fused products was ligated with the 13450-bp SfiI-BamHI and 2586-bp BamHI-MluI fragments of pBAC/$SA_{14}$-14-2.

(ii) 14 E-244 mutants ($G^{244}E$, $G^{244}D$, $G^{244}R$, $G^{244}K$, $G^{244}F$, $G^{244}W$, $G^{244}T$, $G^{244}S$, $G^{244}N$, $G^{244}Q$, $G^{244}L$, $G^{244}P$, $G^{244}A$, and $G^{244}V$):

The same cloning strategy as described for the construction of the $G^{1708}A$ mutant (now renamed $G^{244}E$) was used. For the other 13 mutants, two fragments were first amplified by PCR with the following two primer pairs: $G^{244}D$, 1708-1fw+DR/DF+1708-2rv; $G^{244}R$, 1708-1fw+RR/RF+1708-2rv; $G^{244}K$, 1708-1fw+KR/KF+1708-2rv; $G^{244}F$, 1708-1fw+FR/FF+1708-2rv; $G^{244}W$, 1708-1fw+WR/WF+1708-2rv; $G^{244}T$, 1708-1fw+TR/TF+1708-2rv; $G^{244}S$, 1708-1fw+SR/SF+1708-2rv; $G^{244}N$, 1708-1fw+NR/NF+1708-2rv; $G^{244}Q$, 1708-1fw+QR/QF+1708-2rv; $G^{244}L$, 1708-1fw+LR/LF 1708-2rv; $G^{244}P$, 1708-1fw+PR/PF+1708-2rv; $G^{244}A$, 1708-1fw+AR/AF+1708-2rv; and $G^{244}V$, 1708-1fw+VR/VF+1708-2rv. In all cases, these two fragments were then fused by a second round of PCR with the 1708-1fw and 1708-2rv primers, and the 762-bp NheI-BsrGI fragment of the resulting amplicons was ligated with the 9096-bp BsrGI-NotI and 8716-bp NotI-NheI fragments of pBAC/$SA_{14}$-14-2.

RNA Transcription and Transfection.

All BAC plasmids were purified by centrifugation using CsCl-ethidium bromide equilibrium density gradients. The closed circular plasmids were linearized by XbaI and mung bean nuclease digestion to produce DNA templates for in vitro run-off transcription. RNA was transcribed from a linearized plasmid with SP6 RNA polymerase. The resulting RNA was stored at −80° C. until needed. RNA yield was measured on the basis of the incorporation rate of [$^3$H]UTP, and RNA integrity was evaluated by agarose gel electrophoresis. RNA was transfected by electroporation into BHK-21 cells under our previously optimized conditions. RNA infectivity was determined by infectious center assay. The infectious centers of foci were detected by decorating of cells with a mouse α-JEV antibody (American Type Culture Collection, 1:500) and a horseradish peroxidase (HRP)-conjugated goat α-mouse IgG (Jackson ImmunoResearch, 1:1000), followed by staining with 3,3'-diaminobenzidine (Vector).

Northern Blots.

Total RNA was extracted with TRIzol reagent (Invitrogen). Northern blot analysis was performed. JEV genomic RNA was detected with an antisense riboprobe that binds to a 209-bp region (nucleotide 9143-9351) in the NS5 protein-coding region. The probe was synthesized with [α-$^{32}$P]CTP by using the T7-MEGAscript kit (Ambion). The blots were prehybridized, hybridized, and washed at 55° C. Autoradiographs were obtained by exposure to film for 24-48 hours.

Immunoblots. Cells were lysed in sample buffer (80 mM Tri-HCl [pH 6.8], 2.0% SDS, 10% glycerol, 0.1 M DTT, and 0.2% bromophenol blue). Equal amounts of the lysates were run on SDS-polyacrylamide gels, transferred to polyvinylidene difluoride membranes, and subjected to immunoblotting. The following polyclonal antisera were used as primary antibodies: α-JEV (mouse, 1:1,000), α-C (rabbit, 1:1,000), α-pr (rabbit, 1:4,000), α-E (rabbit, 1:500), α-NS1 (rabbit, 1:1,000), and α-GAPDH (rabbit, 1:10,000). An alkaline phosphatase (AP)-conjugated goat α-mouse or α-rabbit IgG (Jackson ImmunoResearch, 1:5,000) was used for the secondary antibody, as appropriate. The specific signals were visualized by chromogenic membrane staining with a mixture of 5-bromo-4-chloro-3-indolyl-phosphate and nitroblue tetrazolium (Sigma).

Sequence Analysis.

The full genome sequences of $SA_{14}$-14-2 and its neurovirulent variants were determined. Sequencing of the prM-E coding region of the E-244 mutants was done as follows: (i) amplification of a 2069-bp cDNA by RT-PCR using a set of three primers (prMErt, prMEfw, and prMErv; see Table 11); (ii) cloning of a 2057-bp XhoI-SacII fragment into the pRS2 vector; and (iii) sequencing of ~30 randomly picked independent clones containing the insert. Multiple sequence alignments were performed using ClustalX.

Mouse Infection.

Female 3-week-old ICR mice (Charles River) were used. Groups of 10 or 20 mice were inoculated IC (20 μl), IM (50 μl), or IP (50 μl) with 10-fold serial dilutions of virus stock in α-MEM. Mice were monitored for any JEV-induced clinical signs or death every 12 hours for 24 days. The $LD_{50}$ values were determined by the Reed and Muench method. In all mice, viral replication in brain tissues was confirmed by plaque titration and/or RT-PCR.

Immunohistochemistry.

Groups of 3-week-old female ICR mice (n=15 per group) were infected IC with $10^3$ PFU of virus in 20 μl of α-MEM; 10 control mice were inoculated IC with an equivalent volume of supernatant from uninfected control BHK-21 cell cultures at comparable dilution. At 3, 5, and 7 dpi, five randomly selected mice were transcardially perfused with ice-cold phosphate buffered saline (PBS), followed by 4% paraformaldehyde (PFA). Brains were fixed in 4% PFA, embedded in paraffin, and cut into 6-μm sections. Brain sections were treated in microwave for antigen retrieval and incubated with 1% $H_2O_2$ in ice-cold methanol for 30 minutes to block endogenous peroxidase. They were then blocked with 1% normal goat serum and incubated with rabbit α-NS1 antiserum (1:200) for 12 hours at 4° C., followed by incubation with biotinylated α-rabbit IgG plus the avidin-biotin-peroxidase complex (Vector). Signals were visualized by staining with 3,3'-diaminobenzidine solution containing 0.003% $H_2O_2$ and counterstaining with hematoxylin.

Homology Modeling.

The sequence and structure of the E ectodomain of WNV NY99 (PDB accession code 2HG0) was used as template for the homology modeling. The sequence alignment was done using the online version of ClustalW2. Protein structure homology modeling was performed using the SWISS-MODEL Workspace, accessible via the ExPASy web server. The generated model was visualized using UCSF Chimera 1.5.3. The model is in agreement with a recent crystal structure of the E ectodomain of JEV $SA_{14}$-14-2.

Example 11. Construction and Characterization of a Full-Length Infectious cDNA of $SA_{14}$, the Pathogenic Parent of $SA_{14}$-14-2

Figure 14:
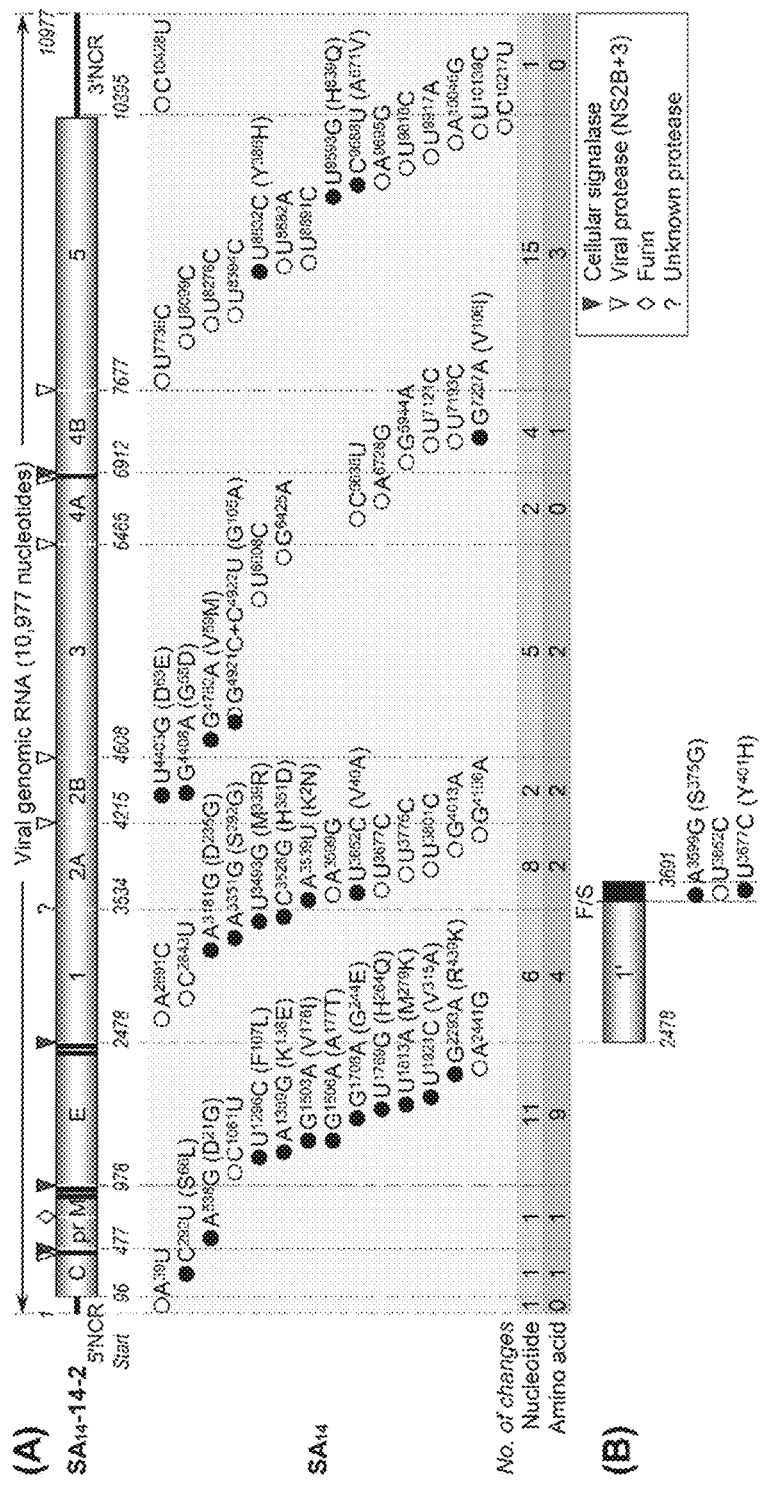
FIG. 14. Comparison of the genome sequences between JEV $SA_{14}$-14-2 and $SA_{14}$. The location of genetic changes was indicated by open circles (silent mutation) or solid circles (missense mutation) on the genomic RNA (A) or on the coding region of NS1' (B). F/S, frameshift site.
Figure 15:
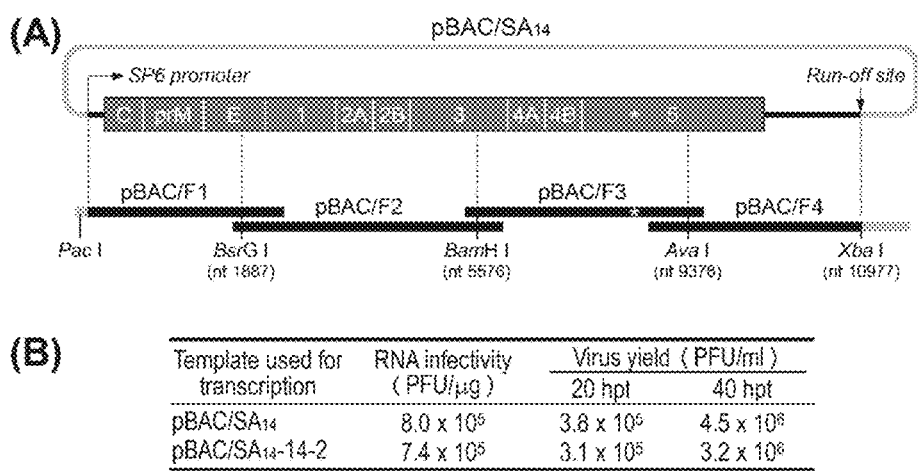
FIG. 15. Creation of a full-length infectious cDNA clone of JEV $SA_{14}$. (A) Strategy for the construction of the full-length $SA_{14}$ cDNA. (B) After transfection of BHK-21 cells with the RNAs transcribed from each cDNA, RNA infectivity and virus yield were determined. An asterisk indicates a silent point mutation ($A^{9134}$→T) introduced during cDNA construction. hpt, hours post-transfection.

In addition to the above-described construction and characterization of the infectious $SA_{14}$-14-2 cDNA, an infectious cDNA for $SA_{14}$ was also constructed. $SA_{14}$ is the wild-type parent of $SA_{14}$-14-2, which is a live attenuated JE vaccine virus. The complete nucleotide sequence of the genomic RNA of $SA_{14}$ was determined using the optimized sequencing protocol described in Yun et al. (2014) PLOS Pathog. 10:e1004290, Yun et al. (2003) J. Virol. 77:6450-6465, and Yun et al. (2003) Virus Res. 96:129-140, the entire contents of each of which are incorporated herein by reference. A total of 57 nucleotide changes (27 amino acid substitutions) were identified between these two viruses (FIG. 14). Next, the same cloning strategy used for the creation of an infectious $SA_{14}$-14-2 cDNA (pBAC/$SA_{14}$-14-2) as described above was applied to construct a full-length $SA_{14}$ cDNA (pBAC/$SA_{14}$), by sequential joining of four overlapping $SA_{14}$ cDNAs at three natural restriction sites (BsrGI, BamHI, and AvaI) within the viral genome (FIG. 15A). The functionality of pBAC/$SA_{14}$ was examined by determining the infectivity of the RNAs synthesized in vitro from pBAC/$SA_{14}$ after transfection into BHK-21 cells. The data showed that the synthetic RNAs derived from pBAC/$SA_{14}$ were highly infectious, similar to those generated from pBAC/$SA_{14}$-14-2, producing a high titer of molecularly defined, infectious virus (FIG. 15B).

Example 12. Nucleotide Sequences

Several nucleotide sequences useful in carrying out various embodiments of the invention are disclosed herein. SEQ ID NO:32 is the nucleotide sequence of the cDNA corresponding to the genomic RNA of JEV $SA_{14}$ (a total of 10,977 nucleotides). SEQ ID NO:33 is the nucleotide sequence of the full-length infectious $SA_{14}$ cDNA molecular clone (a total of 18,574 nucleotides).

CLAUSES

For reasons of completeness, various aspects of the invention are set out in the following numbered clauses.

Clause 1. A DNA construct comprising a cDNA sequence that encodes a JEV genomic RNA and has a nucleotide sequence set forth in SEQ ID NO:1 or SEQ ID NO:32.

Clause 2. The DNA construct of clause 1, further comprising a bacterial artificial chromosome.

Clause 3. The DNA construct of clause 2, wherein the DNA construct comprises a nucleotide sequence set forth in SEQ ID NO:2 when the cDNA sequence has the nucleotide sequence set forth in SEQ ID NO:1, and wherein the DNA construct comprises a nucleotide sequence set forth in SEQ ID NO:33 when the cDNA sequence has the nucleotide sequence set forth in SEQ ID NO:32.

Clause 4. The DNA construct of clause 3, wherein the DNA construct consists of the nucleotide sequence set forth in SEQ ID NO:2 or SEQ ID NO:33.

Clause 5. A DNA construct comprising a nucleic acid sequence that encodes a JEV genomic RNA and has at least about 70% identity to a nucleotide sequence as set forth in SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, or SEQ ID NO:17.

Clause 6. The DNA construct of clause 5, wherein the nucleic acid sequence has at least about 90% identity to the nucleotide sequence as set forth in SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, or SEQ ID NO:17.

Clause 7. The DNA construct of clause 5, wherein the nucleic acid sequence is the nucleotide sequence as set forth in SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, or SEQ ID NO:17.

Clause 8. A DNA construct comprising a nucleic acid sequence that encodes a JEV genomic RNA that encodes an amino acid sequence having at least about 80% identity with an amino acid sequence set forth in SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, or SEQ ID NO:31.

Clause 9. The DNA construct of clause 8, wherein the JEV genomic RNA encodes an amino acid sequence having at least 90% identity with the amino acid sequence set forth in SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, or SEQ ID NO:31.

Clause 10. The DNA construct of clause 8, wherein the JEV genomic RNA encodes the amino acid sequence set forth in SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, or SEQ ID NO:31.

Clause 11. A vector comprising the DNA construct of clauses 1-9 or 10.

Clause 12. A vaccine comprising an JEV virion, wherein the JEV virion includes an RNA encoded by SEQ ID NO:1, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, or SEQ ID NO:32.

Clause 13. The vaccine of clause 12, further comprising an adjuvant.

Clause 14. A method of treating and/or preventing disease associated with JEV in a subject in need thereof, the method comprising administering the vaccine of clause 12 to the subject.

Clause 15. A method of identifying a drug agent that targets an ij-hairpin of a *flavivirus*, the method comprising: (a) exposing cells capable of being infected with a *flavivirus* to experimental conditions that lead to productive infection; (b) adding a candidate drug agent to the cells before or after infection; and (c) determining a level of viral RNA, protein, or particles in the presence and absence of the candidate drug agent.

Clause 16. The method of clause 15, wherein the addition step includes mixing the candidate drug agent with the cells, *flavivirus*, or both the cells and *flavivirus*.

Clause 17. The method of clause 15, wherein the *flavivirus* is JEV, WNV, SLEV, MVEV, DENV, YFV, or tick-borne encephalitis virus.

Clause 18. The method of clause 17, wherein the *flavivirus* is JEV.

Clause 19. The method of clause 18, wherein the JEV includes an RNA encoded by SEQ ID NO:4, SEQ ID NO:5, SEQ ID NO:6, SEQ ID NO:7, SEQ ID NO:8, SEQ ID NO:9, SEQ ID NO:16, SEQ ID NO:17, or SEQ ID NO:32.

Clause 20. The method of clause 18, wherein the JEV includes an RNA that encodes an amino acid sequence as set forth in SEQ ID NO:18, SEQ ID NO:19, SEQ ID NO:20, SEQ ID NO:21, SEQ ID NO:22, SEQ ID NO:23, SEQ ID NO:30, SEQ ID NO:31, or SEQ ID NO:34.

Clause 21. The method of clause 15, wherein the candidate drug agent is a peptide, an antibody, or a small molecule.

Clause 22. The method of clause 15, further comprising identifying the candidate drug agent as targeting the ij-hairpin when the level of viral RNA, protein, or particles in the presence of the candidate drug is decreased as compared to the level of viral RNA, protein, or particles in the absence of the candidate drug.

Clause 23. The method of clause 21, wherein the viral protein is C, prM/M, E, NS1/1', NS2A, NS2B, NS3, NS4A, NS4B, or NS5 protein, or any combination thereof.

It will be appreciated that the various above-disclosed and other features and functions, or alternatives thereof, may be desirably combined into many other different systems or applications. Also, various presently unforeseen or unanticipated alternatives, modifications, variations or improvements therein may be subsequently made by those skilled in the art, and are also intended to be encompassed by the following claims.

SEQUENCE LISTING (111 sequences)

SEQ ID NO: 1 - DNA, 10977 bp, Artificial Sequence
  JEV SA14-14-2 MCV
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaggggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 2 - DNA, 18574 bp, Artificial Sequence
  pBAC/SA14-14-2
gagaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaggggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatctctagagcggccgcggaccgactagcctcttttcggccttcgctgagagggatttgttccctaggcctaattattatttttaattgcccaatacgtatacgagtgccttttctaattctcgtatactatagtgagtcgtattatctagccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgtgtctcaaaatctctgatgttacattgcacaagataaaaatatatcatcatgaacaataaaactgtctgcttacataaacagtaatacaaggggtgttatgagccatattcaacgggaaacgtcttgctcgacgatgataagctgtcaaacatgagaattgggtcgtcaatatgctaaaacgcggcataccccgcgtattcccactagttaattaacctgcagggggctgttagaggtcttccctagtccaactatagcgtatggacatattgtcgttagaacgcggctacaattaatacataaccttatgtatcatacacatacgatttaggggacactata

SEQ ID NO: 3 - protein, 3432 aa, Artificial Sequence
  JEV SA14-14-2 MCV
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEGAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 4 - DNA, 10977 bp, Artificial Sequence
  JEV G244E
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaagaggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 5 - DNA, 10977 bp, Artificial Sequence
  JEV G244D
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaagacgcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 6 - DNA, 10977 bp, Artificial Sequence
  JEV G244T
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaacggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 7 - DNA, 10977 bp, Artificial Sequence
  JEV G244S
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaagcgcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 8 - DNA, 10977 bp, Artificial Sequence
  JEV G244Q
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaacaggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 9 - DNA, 10977 bp, Artificial Sequence
  JEV G244P
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaccggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 10 - DNA, 10977 bp, Artificial Sequence
  JEV G244R
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaagagcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 11 - DNA, 10977 bp, Artificial Sequence
  JEV G244K
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaaaggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 12 - DNA, 10977 bp, Artificial Sequence
  JEV G244F
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaattcgcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 13 - DNA, 10977 bp, Artificial Sequence
  JEV G244W
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaatgggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 14 - DNA, 10977 bp, Artificial Sequence
  JEV G244N
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaaacgcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 15 - DNA, 10977 bp, Artificial Sequence
  JEV G244L
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaactggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 16 - DNA, 10977 bp, Artificial Sequence
  JEV G244A
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaagccgcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 17 - DNA, 10977 bp, Artificial Sequence
  JEV G244V
agaagtttatctgtgtgaacttcttggcttagtatcgtagagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgctttcaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcagacgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaagtcgcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtaagggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcatcctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatgatgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtagcaagagaggcccttcggtcagaaccactactgacagtggaaagttgatcactgactggtgctgtcgcagttgctcccttccgcccctacgattccggacagaaaatggctgctggtacggaatggaaatcagacctgttatgcatgatgaaacaacactcgtcagatcacaggttcatgctttcaaaggtgaaatggttgacccttttcagctgggccttctggtgatgtttctggccacccaggaagtccttcgcaagaggtggacggccagattgaccattcctgcggttttgggggtcctacttgtgctgatgcttgggggtatcacttacactgatttggcgaggtatgtggtgctagtcgctgctgctttcgcagaggccaacagtggaggagacgtcctgcaccttgctttgattgctgtttttaagatccaaccagcatttttagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccggggatgagggctctatacctagacacttacagaatcatcctcctcgtcatagggatttgctccctgctgcacgagaggaaaaagaccatggcgaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggatatgggtgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattgtgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaagggcgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaatcaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaggccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgtcgccattactgtgatgacaggaggattcttcctactaatgatgcagcgaaagggtatagggaagatgggtcttggagctctagtgctcacactagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcggatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcttcaattaactcacaagctggctcattattcgtcttgccacgaggcgtgccttttaccgacctagacttgactgttggcctcgtcttccttggctgttggggtcaagtcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagtagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgataccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgtcgcttcggaggtgggctagtgcgtctccccctgtcccgaaactccaatcacgagatgtattgggttagtggagccgctggcaatgtggtgcacgctgtgaacatgaccagccaggtattactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcctacttgtcacgggaaaaaagaccccgcttgtgcaccaaggaagaattcattaagaaagttaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacatctacctaggaaaaacaagatagctgtcaggacctggctctttgagaatggagaggagagagtgaccaggatggcgatcagcggagacgactgtgccgtcaaaccgctggacgacagattcgccacagccctccacttcctcaacgcaatgtcaaaggtcagaaaagacatccaggaatggaagccttcgcatggctggcacgattggcagcaagttcccttctgttctaaccattttcaggagattgtgatgaaagatggaaggagtatagttgtcccgtgcagaggacaggatgagctgataggcagggctcgcatctctcctggagctggatggaatgtgaaggacacagcttgcctggccaaagcatatgcacagatgtggctactcctatacttccatcgcagggacttgcgtctcatggcaaatgcgatttgctcagcagtgccagtagattgggtgcccacaggcaggacatcctggtcaatacactcgaaaggagagtggatgaccacggaagacatgctgcaggtctggaacagagtttggattgaagaaaatgaatggatgatggacaagactccaatcacaagctggacagacgttccgtatgtgggaaagcgcgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaacaatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 18 - protein, 3432 aa, Artificial Sequence
  JEV G244E
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEEAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 19 - protein, 3432 aa, Artificial Sequence
  JEV G244D
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEDAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 20 - protein, 3432 aa, Artificial Sequence
  JEV G244T
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFETAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 21 - protein, 3432 aa, Artificial Sequence
  JEV G244S
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFESAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 22 - protein, 3432 aa, Artificial Sequence
  JEV G244Q
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEQAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 23 - protein, 3432 aa, Artificial Sequence
  JEV G244P
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEPAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 24 - protein, 3432 aa, Artificial Sequence
  JEV G244R
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFERAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 25 - protein, 3432 aa, Artificial Sequence
  JEV G244K
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEKAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 26 - protein, 3432 aa, Artificial Sequence
  JEV G244F
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEFAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 27 - protein, 3432 aa, Artificial Sequence
  JEV G244W
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEWAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 28 - protein, 3432 aa, Artificial Sequence
  JEV G244N
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFENAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 29 - protein, 3432 aa, Artificial Sequence
  JEV G244L
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFELAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 30 - protein, 3432 aa, Artificial Sequence
  JEV G244A
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEAAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 31 - protein, 3432 aa, Artificial Sequence
  JEV G244V
MTKKPGGPGKNRAINMLKRGLPRVFPLVGVKRVVMSLLDGRGPVRFVLALITFFKFTALAPTKALSGRWKAVEKSVAMKHLTSFKRELGTLIDAVNKRGRKQNKRGGNEGSIMWLASLAVVIACAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEVAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDDVEESELIIPHTIAGPKSKHNRREGYKTQNQGPWDENGIVLDFDYCPGTKVTITEDCSKRGPSVRTTTDSGKLITDWCCRSCSLPPLRFRTENGCWYGMEIRPVMHDETTLVRSQVHAFKGEMVDPFQLGLLVMFLATQEVLRKRWTARLTIPAVLGVLLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWDMGAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIVSGEGKLTPYWGSVKEDRIAYGGPWRFDRKWNGTDDVQVIVVEPGKGAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQVTLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAYLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEHLPRKNKIAVRTWLFENGEERVTRMAISGDDCAVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 32 - DNA, 10977 bp, Artificial Sequence
  JEV SA14 MCV
agaagtttatctgtgtgaacttcttggcttagtatcgttgagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgcttttaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcaggcgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagatagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggacttttcgggaagggaagcattgacacatgtgcaaaattctcctgcaccagtaaagcgattgggagaacaatccagccagaaaacatcaaatacgaagttggcatttttgtgcatggaaccaccacttcggaaaaccatgggaattattcagcgcaagttggggcgtcccaggcggcaaagtttacagtaacacccaatgctccttcgataaccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaagaggcgcacgccacaaaacagtccgttgttgctcttgggtcacaggaaggaggcctccatcaggcgttggcaggagccatcgtggtggagtactcaagctcagtgaagttaacatcaggccacctgaaatgtaggctgaaaatggacaaactggctctgaaaggcacaacctatggcatgtgtacagaaaaattctcgttcgcgaaaaatccggcggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaaaagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacagggggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtacgggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcattctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatggtgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtggcaagagaggcccttcggtcagaaccactactgacagtggaaagttgatcactgactggtgctgtcgcagttgctcccttccgcccctacgattccggacagaaaatggctgctggtacggaatggaaatcagacctgttaggcatgatgaaacaacactcgtcagatcacaggttgatgctttcaatggtgaaatggttgacccttttcagctgggccttctggtgatgtttctggccacccaggaggtccttcgcaagaggtggacggccagattgaccattcctgcggttttgggggccctacttgtgctgatgcttgggggcatcacttacactgatttggcgaggtatgtggtgctagtcgctgctgctttcgcagaggccaacagtggaggagacgtcctgcaccttgctttgattgccgtttttaagatccaaccagcatttctagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccagggatgagggctctatacctagacacttacagaatcatcctcctcgtcatagggatttgctccctgctgcacgagaggaaaaagaccatggcaaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggagatggatgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattatgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaaggctgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaaccaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaagccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgttgccattactgtgatgacaggaggattcttcctactaatgatgcagcgaaagggtatagggaagatgggtcttggagctctagtgctcacgctagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcagatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcctcaattaactcacaagctggctcattattcgtcttgccacgaggcgtgccttttaccgacctagacttgaccgttggcctcgtcttccttggctgttggggtcaaatcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagcagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgacaccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgccgcttcggaggtgggctagtgcgtctccccctgtcccgaaactccaatcacgagatgtattgggttagtggagccgctggcaatgtggtgcacgctgtgaacatgaccagccaggtactactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcccacttgtcacgggaaaaaagaccccgcttgtgcaccaaggaagaattcataaagaaagtcaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacagctacctaggaaaaacaagatagctgtcaggacctggctctttgagaatggagaggagagagtgaccaggatggcgatcagcggagacgactgtgtcgtcaagccgctggacgacagattcgccacagccctccacttcctcaacgcaatgtcaaaggtcagaaaagacatccaggaatggaagccttcgcatggctggcacgattggcagcaagttcccttctgctctaaccattttcaggagattgtgatgaaagatggaaggagtatagttgtcccgtgcagaggacaggatgagctgataggcagggctcgcatctctccaggagctggatggaatgtgaaggacacagcttgcctggccaaagcatatgcacagatgtggctactcctatacttccatcgcagggacttgcgtctcatggcaaatgcgatttgctcagcagtgccagtggattgggtgcccacaggcaggacatcctggtcaatacactcgaaaggagagtggatgaccacggaagacatgctgcaggtctggaacagagtctggattgaagaaaatgaatggatgatggacaagactccaatcacaagctggacagacgttccgtatgtgggaaagcgtgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaataatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatct

SEQ ID NO: 33 - DNA, 18574 bp, Artificial Sequence
  pBAC/SA14
gagaagtttatctgtgtgaacttcttggcttagtatcgttgagaagaatcgagagattagtgcagtttaaacagttttttagaacggaagataaccatgactaaaaaaccaggagggcccggtaaaaaccgggctatcaatatgctgaaacgcggcctaccccgcgtattcccactagtgggagtgaagagggtagtaatgagcttgttggacggcagagggccagtacgtttcgtgctggctcttatcacgttcttcaagtttacagcattagccccgaccaaggcgcttttaggccgatggaaagcagtggaaaagagtgtggcaatgaaacatcttactagtttcaaacgagaacttggaacactcattgacgccgtgaacaagcggggcagaaagcaaaacaaaagaggaggaaatgaaggctcaatcatgtggctcgcgagcttggcagttgtcatagcttgtgcaggagccatgaagttgtcgaatttccaggggaagcttttgatgaccatcaacaacacggacattgcaggcgttatcgtgattcccacctcaaaaggagagaacagatgctgggtccgggcaatcgacgtcggctacatgtgtgaggacactatcacgtacgaatgtcctaagcttaccatgggcaatgatccagaggatgtggattgctggtgtgacaaccaagaagtctacgtccaatatggacggtgcacgcggaccaggcattccaagcgaagcaggagatccgtgtcggtccaaacacatggggagagttcactagtgaataaaaaagaggcttggctggattcaacgaaagccacacgatatctcatgaaaactgagaactggatcataaggaatcctggctatgctttcctggcggcggtacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggacttggtgctagaaggagatagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggacttttcgggaagggaagcattgacacatgtgcaaaattctcctgcaccagtaaagcgattgggagaacaatccagccagaaaacatcaaatacgaagttggcatttttgtgcatggaaccaccacttcggaaaaccatgggaattattcagcgcaagttggggcgtcccaggcggcaaagtttacagtaacacccaatgctccttcgataaccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaagaggcgcacgccacaaaacagtccgttgttgctcttgggtcacaggaaggaggcctccatcaggcgttggcaggagccatcgtggtggagtactcaagctcagtgaagttaacatcaggccacctgaaatgtaggctgaaaatggacaaactggctctgaaaggcacaacctatggcatgtgtacagaaaaattctcgttcgcgaaaaatccggcggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggccttttcaacaactttgaagggagctcaaagactggcagcgttgggcgacacagcctgggactttggctctattggaggggtcttcaactccataggaaaagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacagggggtgtgctcgtgttcttagcgaccaatgtgcatgctgacactggatgtgccattgacatcacaagaaaagagatgagatgtggaagtggcatcttcgtgcacaacgacgtggaagcctgggtggataggtataaatatttgccagaaacgcccagatccctagcgaagatcgtccacaaagcgcacaaggaaggcgtgtgcggagtcagatctgtcactagactggagcaccaaatgtgggaagccgtacgggacgaattgaacgtcctgctcaaagagaatgcagtggacctcagtgtggttgtgaacaagcccgtgggaagatatcgctcagcccctaaacgcctatccatgacgcaagagaagtttgaaatgggctggaaagcatggggaaaaagcattctctttgccccggaattggctaactccacatttgtcgtagatggacctgagacaaaggaatgccctgatgagcacagagcttggaacagcatgcaaatcgaagacttcggctttggcatcacatcaacccgtgtgtggctgaaaattagagaggagagcactgacgagtgtgatggagcgatcataggcacggctgtcaaaggacatgtggcagtccatagtgacttgtcgtactggattgagagtcgctacaacgacacatggaaacttgagagggcagtctttggagaggtcaaatcttgcacttggccagagacacacaccctttggggagatggtgttgaggaaagtgaactcatcattccgcacaccatagccggaccaaaaagcaagcacaatcggagggaagggtataagacacaaaaccagggaccttgggatgagaatggcatagtcttggactttgattattgcccagggacaaaagtcaccattacagaggattgtggcaagagaggcccttcggtcagaaccactactgacagtggaaagttgatcactgactggtgctgtcgcagttgctcccttccgcccctacgattccggacagaaaatggctgctggtacggaatggaaatcagacctgttaggcatgatgaaacaacactcgtcagatcacaggttgatgctttcaatggtgaaatggttgacccttttcagctgggccttctggtgatgtttctggccacccaggaggtccttcgcaagaggtggacggccagattgaccattcctgcggttttgggggccctacttgtgctgatgcttgggggcatcacttacactgatttggcgaggtatgtggtgctagtcgctgctgctttcgcagaggccaacagtggaggagacgtcctgcaccttgctttgattgccgtttttaagatccaaccagcatttctagtgatgaacatgcttagcacgagatggacgaaccaagaaaacgtggttctggtcctaggggctgcctttttccaattggcctcagtagatctgcaaataggagtccacggaatcctgaatgccgccgctatagcatggatgattgtccgagcgatcaccttccccacaacctcctccgtcaccatgccagtcttagcgcttctaactccagggatgagggctctatacctagacacttacagaatcatcctcctcgtcatagggatttgctccctgctgcacgagaggaaaaagaccatggcaaaaaagaaaggagctgtactcttgggcttagcgctcacatccactggatggttctcgcccaccactatagctgccggactaatggtctgcaacccaaacaagaagagagggtggccagctactgagtttttgtcggcagttggattgatgtttgccatcgtaggtggtttggccgagttggatattgaatccatgtcaatacccttcatgctggcaggtctcatggcagtgtcctacgtggtgtcaggaaaagcaacagatatgtggcttgaacgggccgccgacatcagctgggagatggatgctgcaatcacaggaagcagtcggaggctggatgtgaaactggatgatgacggagattttcacttgattgatgatcccggtgttccatggaaggtctgggtcctgcgcatgtcttgcattggcttagccgccctcacgccttgggccatcgttcccgccgctttcggttattggctcactttaaaaacaacaaaaagagggggcgtgttttgggacacgccatccccaaaaccttgctcaaaaggagacaccactacaggagtctaccgaattatggctagagggattcttggcacttaccaggccggcgtcggagtcatgtacgagaatgttttccacacactatggcacacaactagaggagcagccattatgagtggagaaggaaaattgacgccatactggggtagtgtgaaagaagaccgcatagcttacggaggcccatggaggtttgaccgaaaatggaatggaacagatgacgtgcaagtgatcgtggtagaaccggggaaggctgcagtaaacatccagacaaaaccaggagtgtttcggactcccttcggggaggttggggctgttagtctggattacccgcgaggaacatccggctcacccattctggattccaatggagacattataggcctatacggcaatggagttgagcttggcgatggctcatacgtcagcgccatcgtgcagggtgaccgtcaggaggaaccagtcccagaagcttacaccccaaacatgttgagaaagagacagatgactgtgctagatttgcaccctggttcagggaaaaccaggaaaattctgccacaaataattaaggacgctatccagcagcgcctaagaacagctgtgttggcaccgacgcgggtggtagcagcagaaatggcagaagctttgagagggctcccagtacgatatcaaacttcagcagtgcagagagagcaccaagggaatgaaatagtggatgtgatgtgccacgccactctgacccatagactgatgtcaccgaacagagtgcccaactacaacctatttgtcatggatgaagctcatttcaccgacccagccagtatagccgcacgaggatacattgctaccaaggtggaattaggggaggcagcagccatctttatgacagcgaccccgcctggaaccacggatccttttcctgactcaaatgccccaatccatgatttgcaagatgagataccagacagggcatggagcagtggatacgaatggatcacagaatatgcgggtaaaaccgtgtggtttgtggcgagcgtaaaaatggggaatgagattgcaatgtgcctccaaagagcggggaaaaaggtcatccaactcaaccgcaagtcctatgacacagaatacccaaaatgtaagaatggagactgggattttgtcattaccaccgacatctctgaaatgggggccaacttcggtgcgagcagggtcatcgactgtagaaagagcgtgaaacccaccatcttagaagagggagaaggcagagtcatcctcggaaacccatctcccataaccagtgcaagcgcagctcaacggaggggcagagtaggcagaaaccccaaccaagttggagatgaataccactatgggggggctaccagtgaagatgacagtaacctagcccattggacagaggcaaagatcatgttagacaacatacacatgcccaatggactggtggcccagctctatggaccagagagggaaaaggctttcacaatggatggcgaataccgtctcagaggtgaagaaaagaaaaacttcttagagctgcttaggacggctgacctcccggtgtggctggcctacaaggtggcgtccaatggcattcagtacaccgacagaaagtggtgttttgatgggccgcgtacgaatgccatactggaggacaacaccgaggtagagatagtcacccggatgggtgagaggaaaatcctcaagccgagatggcttgatgcaagagtttatgcagatcaccaagccctcaagtggttcaaagactttgcagcagggaagagatcagccgttagcttcatagaggtgctcggtcgcatgcctgagcatttcatgggaaagacgcgggaagctttagacaccatgtacttggttgcaacggctgagaaaggtgggaaagcacaccgaatggctctcgaagagctgccagatgcactggaaaccatcacacttattgttgccattactgtgatgacaggaggattcttcctactaatgatgcagcgaaagggtatagggaagatgggtcttggagctctagtgctcacgctagctaccttcttcctgtgggcggcagaggttcctggaaccaaaatagcagggaccctgctgatcgccctgctgctgatggtggttctcatcccagaaccggaaaaacagaggtcacagacagataaccaactggcggtgtttctcatctgtgtcttgaccgtggttggagtggtggcagcaaacgagtacgggatgctagaaaaaaccaaagcagatctcaagagcatgtttggcggaaagacgcaggcatcaggactgactggattgccaagcatggcactggacctgcgtccagccacagcctgggcactgtatggggggagcacagtcgtgctaacccctcttctgaagcacctgatcacgtcggaatacgtcaccacatcgctagcctcaattaactcacaagctggctcattattcgtcttgccacgaggcgtgccttttaccgacctagacttgaccgttggcctcgtcttccttggctgttggggtcaaatcaccctcacaacgtttctgacagccatggttctggcgacacttcactatgggtacatgctccctggatggcaagcagaagcactcagggctgcccagagaaggacagcggctggaataatgaagaatgccgttgttgacggaatggtcgccactgatgtgcctgaactggaaaggactactcctctgatgcaaaagaaagtcggacaggtgctcctcataggggtaagcgtggcagcgttcctcgtcaaccctaatgtcaccactgtgagagaagcaggggtgttggtgacggcggctacgcttactttgtgggacaatggagccagtgccgtttggaattccaccacagccacgggactctgccatgtcatgcgaggtagctacctggctggaggctccattgcttggactctcatcaagaacgctgataagccctccttgaaaaggggaaggcctgggggcaggacgctaggggagcagtggaaggaaaaactaaatgccatgagcagagaagagttttttaaataccggagagaggccataatcgaggtggaccgcactgaagcacgcagggccagacgtgaaaataacatagtgggaggacatccggtttcgcgaggctcagcaaaactccgttggctcgtggagaaaggatttgtctcgccaataggaaaagtcattgatctagggtgtgggcgtggaggatggagctactacgcagcaaccctgaagaaggtccaggaagtcagaggatacacgaaaggtggggcgggacatgaagaaccgatgctcatgcagagctacggctggaacctggtctccctgaagagtggagtggacgtgttttacaaaccttcagagcccagtgacaccctgttctgtgacataggggaatcctccccaagtccagaagtagaagaacaacgcacactacgcgtcctagagatgacatctgactggttgcaccgaggacctagagagttctgcattaaagttctctgcccttacatgcccaaggttatagaaaaaatggaagttctgcagcgccgcttcggaggtgggctagtgcgtctccccctgtcccgaaactccaatcacgagatgtattgggttagtggagccgctggcaatgtggtgcacgctgtgaacatgaccagccaggtactactggggcgaatggatcgcacagtgtggagagggccaaagtatgaggaagatgtcaacctagggagcggaacaagagccgtgggaaagggagaagtccatagcaatcaggagaaaatcaagaagagaatccagaagcttaaagaagaattcgccacaacgtggcacaaagaccctgagcatccataccgcacttggacataccacggaagctatgaagtgaaggctactggctcagccagctctctcgtcaacggagtggtgaagctcatgagcaaaccttgggacgccattgccaacgtcaccaccatggccatgactgacaccaccccttttggacagcaaagagttttcaaggagaaagttgacacgaaggctcctgagccaccagctggagccaaggaagtgctcaacgagaccaccaactggctgtgggcccacttgtcacgggaaaaaagaccccgcttgtgcaccaaggaagaattcataaagaaagtcaacagcaacgcggctcttggagcagtgttcgctgaacagaatcaatggagcacggcgcgtgaggctgtggatgacccgcggttttgggagatggttgatgaagagagggaaaaccatctgcgaggagagtgtcacacatgtatctacaacatgatgggaaaaagagagaagaagcctggagagtttggaaaagctaaaggaagcagggccatttggttcatgtggcttggagcacggtatcttgagtttgaagctttggggttcctgaatgaagaccattggctgagccgagagaattcaggaggtggagtggaaggctcaggcgtccaaaagctgggatacatcctccgtgacatagcaggaaagcaaggagggaaaatgtacgctgatgataccgccgggtgggacactagaattaccagaactgatttagaaaatgaagctaaggtactggagctcctagacggtgaacaccgcatgctcgcccgagccataattgaactgacttacaggcacaaagtggtcaaggtcatgagacctgcagcagaaggaaagaccgtgatggacgtgatatcaagagaagatcaaagggggagtggacaggtggtcacttatgctcttaacactttcacgaacatcgctgtccagctcgtcaggctgatggaggctgagggggtcattggaccacaacacttggaacagctacctaggaaaaacaagatagctgtcaggacctggctctttgagaatggagaggagagagtgaccaggatggcgatcagcggagacgactgtgtcgtcaagccgctggacgacagattcgccacagccctccacttcctcaacgcaatgtcaaaggtcagaaaagacatccaggaatggaagccttcgcatggctggcacgattggcagcaagttcccttctgctctaaccattttcaggagattgtgatgaaagatggaaggagtatagttgtcccgtgcagaggacaggatgagctgataggcagggctcgcatctctccaggagctggatggaatgtgaaggacacagcttgcctggccaaagcatatgcacagatgtggctactcctatacttccatcgcagggacttgcgtctcatggcaaatgcgatttgctcagcagtgccagtggattgggtgcccacaggcaggacatcctggtcaatacactcgaaaggagagtggatgaccacggaagacatgctgcaggtctggaacagagtctggattgaagaaaatgaatggatgatggacaagactccaatcacaagctggacagacgttccgtatgtgggaaagcgtgaggacatctggtgtggcagcctcatcggaacgcgatccagagcaacctgggctgagaacatctatgcggcgataaaccaggttagagctgtcattgggaaagaaaattatgttgactacatgacctcactcaggagatacgaagacgtcttgatccaggaagacagggtcatctagtgtgatttaaggtagaaaagtagactatgtaaataatgtaaatgagaaaatgcatgcatatggagtcaggccagcaaaagctgccaccggatactgggtagacggtgctgcctgcgtctcagtcccaggaggactgggttaacaaatctgacaacagaaagtgagaaagccctcagaaccgtctcggaagtaggtccctgctcactggaagttgaaagaccaacgtcaggccacaaatttgtgccactccgctagggagtgcggcctgcgcagccccaggaggactgggttaccaaagccgttgaggcccccacggcccaagcctcgtctaggatgcaatagacgaggtgtaaggactagaggttagaggagaccccgtggaaacaacaacatgcggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatctctagagcggccgcggaccgactagcctcttttcggccttcgctgagagggatttgttccctaggcctaattattatttttaattgcccaatacgtatacgagtgccttttctaattctcgtatactatagtgagtcgtattatctagccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgtgtctcaaaatctctgatgttacattgcacaagataaaaatatatcatcatgaacaataaaactgtctgcttacataaacagtaatacaaggggtgttatgagccatattcaacgggaaacgtcttgctcgacgatgataagctgtcaaacatgagaattgggtcgtcaatatgctaaaacgcggcataccccgcgtattcccactagttaattaacctgcagggggctgttagaggtcttccctagtccaactatagcgtatggacatattgtcgttagaacgcggctacaattaatacataaccttatgtatcatacacatacgatttaggggacactata

SEQ ID NO: 34 - protein, 3432 aa, Artificial Sequence
  JEV SA14 MCV
MTKKPGGPGKNRAINMLKRGLPRVFPLVGVKRVVMSLLDGRGPVRFVLALITFFKFTALAPTKALLGRWKAVEKSVAMKHLTSFKRELGTLIDAVNKRGRKQNKRGGNEGSIMWLASLAVVIACAGAMKLSNFQGKLLMTINNTDIAGVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGLFGKGSIDTCAKFSCTSKAIGRTIQPENIKYEVGIFVHGTTTSENHGNYSAQVGASQAAKFTVTPNAPSITLKLGDYGEVTLDCEPRSGLNTEAFYVMTVGSKSFLVHREWFHDLALPWTSPSSTAWRNRELLMEFEEAHATKQSVVALGSQEGGLHQALAGAIVVEYSSSVKLTSGHLKCRLKMDKLALKGTTYGMCTEKFSFAKNPADTGHGTVVIELSYSGSDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDGVEESELIIPHTIAGPKSKHNRREGYKTQNQGPWDENGIVLDFDYCPGTKVTITEDCGKRGPSVRTTTDSGKLITDWCCRSCSLPPLRFRTENGCWYGMEIRPVRHDETTLVRSQVDAFNGEMVDPFQLGLLVMFLATQEVLRKRWTARLTIPAVLGALLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLHERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWEMDAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIMSGEGKLTPYWGSVKEDRIAYGGPWRFDRKWNGTDDVQVIVVEPGKAAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGYEWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQITLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAHLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 35 - DNA, 26 bp, Artificial Sequence
  JS1rt
tagggatctgggcgtttctggcaaat

SEQ ID NO: 36 - DNA, 31 bp, Artificial Sequence
  JS1fw
aatcccgggagaagtttatctgtgtgaactt

SEQ ID NO: 37 - DNA, 33 bp, Artificial Sequence
  JS1rv
attgcggccgcccacgtcgttgtgcacgaagat

SEQ ID NO: 38 - DNA, 26 bp, Artificial Sequence
  JS2rt
ttctgcctactctgcccctccgttga

SEQ ID NO: 39 - DNA, 31 bp, Artificial Sequence
  JS2fw
aatcccgggtcaagctcagtgatgttaacat

SEQ ID NO: 40 - DNA, 33 bp, Artificial Sequence
  JS2rv
attgcggccgcgatgggtttccgaggatgactc

SEQ ID NO: 41 - DNA, 26 bp, Artificial Sequence
  JS3rt
acggtctttccttctgctgcaggtct

SEQ ID NO: 42 - DNA, 31 bp, Artificial Sequence
  JS3fw
aatcccggggaggatacattgctaccaaggt

SEQ ID NO: 43 - DNA, 33 bp, Artificial Sequence
  JS3rv
attgcggccgcgtaagtcagttcaattatggct

SEQ ID NO: 44 - DNA, 26 bp, Artificial Sequence
  JS4rt
agatcctgtgttcttcctcaccacca

SEQ ID NO: 45 - DNA, 31 bp, Artificial Sequence
  JS4fw
aatcccgggagtggaaggctcaggcgtccaa

SEQ ID NO: 46 - DNA, 33 bp, Artificial Sequence
  JS4rv
attgcggccgcagatcctgtgttcttcctcacc

SEQ ID NO: 47 - DNA, 22 bp, Artificial Sequence
  JSsp6fw
cataccccgcgtattcccacta

SEQ ID NO: 48 - DNA, 31 bp, Artificial Sequence
  JSsp6rv
acagataaacttctctatagtgtcccctaaa

SEQ ID NO: 49 - DNA, 31 bp, Artificial Sequence
  JSFraglfw
aggggacactatagagaagtttatctgtgtg

SEQ ID NO: 50 - DNA, 25 bp, Artificial Sequence
  JSFraglrv
tggatcattgcccatggtaagctta

SEQ ID NO: 51 - DNA, 25 bp, Artificial Sequence
  JSX1fw
cgaatggatcgcacagtgtggagag

SEQ ID NO: 52 - DNA, 29 bp, Artificial Sequence
  JSX1rv
aaagcttcaaactcaagataccgtgctcc

SEQ ID NO: 53 - DNA, 29 bp, Artificial Sequence
  JSX2fw
ggagcacggtatcttgagtttgaagcttt

SEQ ID NO: 54 - DNA, 25 bp, Artificial Sequence
  JSX2rv
cacgtggacgagggcatgcctgcag

SEQ ID NO: 55 - DNA, 25 bp, Artificial Sequence
  JSROfw
ccaggaggactgggttaccaaagcc

SEQ ID NO: 56 - DNA, 40 bp, Artificial Sequence
  JSROrv
agggcggccgctctagagatcctgtgttcttcctcaccac

SEQ ID NO: 57 - DNA, 29 bp, Artificial Sequence
  317-1rv
ttcattgccacacttttttccactgcttt

SEQ ID NO: 58 - DNA, 29 bp, Artificial Sequence
  317-2fw
aaagcagtggaaaaaagtgtggcaatgaa

SEQ ID NO: 59 - DNA, 29 bp, Artificial Sequence
  419-1rv
atgattgagccttcgtttcctcctctttt

SEQ ID NO: 60 - DNA, 29 bp, Artificial Sequence
  419-2fw
aaaagaggaggaaacgaaggctcaatcat

SEQ ID NO: 61 - DNA, 25 bp, Artificial Sequence
  1708-1fw
acattggacgtccgcatgattaaca

SEQ ID NO: 62 - DNA, 29 bp, Artificial Sequence
  1708-1rv
ttgtggcgtgcgcctcttcaaattccatg

SEQ ID NO: 63 - DNA, 29 bp, Artificial Sequence
  1708-2fw
catggaatttgaagaggcgcacgccacaa

SEQ ID NO: 64 - DNA, 25 bp, Artificial Sequence
  1708-2rv
gatttttcgcgaacgagaatttttc

SEQ ID NO: 65 - DNA, 25 bp, Artificial Sequence
  JSBsrGlw
ctggctctgaaaggcacaacctatg

SEQ ID NO: 66 - DNA, 29 bp, Artificial Sequence
  2580-1rv
gggcgtttctggcagatatttatacctat

SEQ ID NO: 67 - DNA, 29 bp, Artificial Sequence
  2580-2fw
ataggtataaatatctgccagaaacgccc

SEQ ID NO: 68 - DNA, 25 bp, Artificial Sequence
  JSBamHlrv
tcatggattggggcatttgagtcag

SEQ ID NO: 69 - DNA, 29 bp, Artificial Sequence
  3215-1rv
tttggtccggctatagtgtgcggaatgat

SEQ ID NO: 70 - DNA, 29 bp, Artificial Sequence
  3215-2fw
atcattccgcacactatagccggaccaaa

SEQ ID NO: 71 - DNA, 25 bp, Artificial Sequence
  JSBamHlfw
ctttatgacagcgaccccgcctgga

SEQ ID NO: 72 - DNA, 29 bp, Artificial Sequence
  5987-1rv
tttctgcctactctacccctccgttgagc

SEQ ID NO: 73 - DNA, 29 bp, Artificial Sequence
  5987-2fw
gctcaacggaggggtagagtaggcagaaa

SEQ ID NO: 74 - DNA, 25 bp, Artificial Sequence
  5987-2rv
tacctcggtgttgtcctccagtatg

SEQ ID NO: 75 - DNA, 29 bp, Artificial Sequence
  6551-1rv
tcagccgttgcaactaagtacatggtgtc

SEQ ID NO: 76 - DNA, 29 bp, Artificial Sequence
  6551-2fw
gacaccatgtacttagttgcaacggctga

SEQ ID NO: 77 - DNA, 25 bp, Artificial Sequence
  6551-2rv
aataatgagccagcttgtgagttaa

SEQ ID NO: 78 - DNA, 25 bp, Artificial Sequence
  8588-1fw
aagtccagaagtagaagaacaacgc

SEQ ID NO: 79 - DNA, 29 bp, Artificial Sequence
  8588-1rv
ccgtggtatgtccaggtgcggtatggatg

SEQ ID NO: 80 - DNA, 29 bp, Artificial Sequence
  8588-2fw
catccataccgcacctggacataccacgg

SEQ ID NO: 81 - DNA, 25 bp, Artificial Sequence
  8588-2rv
ctattgcatcctagacgaggcttgg

SEQ ID NO: 82 - DNA, 26 bp, Artificial Sequence
  DF
tggaatttgaagacgcgcacgccaca

SEQ ID NO: 83 - DNA, 26 bp, Artificial Sequence
  DR
tgtggcgtgcgcgtcttcaaattcca

SEQ ID NO: 84 - DNA, 26 bp, Artificial Sequence
  AF
tggaatttgaagccgcgcacgccaca

SEQ ID NO: 85 - DNA, 26 bp, Artificial Sequence
  AR
tgtggcgtgcgcggcttcaaattcca

SEQ ID NO: 86 - DNA, 26 bp, Artificial Sequence
  LF
atggaatttgaactggcgcacgccac

SEQ ID NO: 87 - DNA, 26 bp, Artificial Sequence
  LR
gtggcgtgcgccagttcaaattccat

SEQ ID NO: 88 - DNA, 26 bp, Artificial Sequence
  PF
atggaatttgaaccggcgcacgccac

SEQ ID NO: 89 - DNA, 26 bp, Artificial Sequence
  PR
gtggcgtgcgccggttcaaattccat

SEQ ID NO: 90 - DNA, 26 bp, Artificial Sequence
  VF
tggaatttgaagtcgcgcacgccaca

SEQ ID NO: 91 - DNA, 26 bp, Artificial Sequence
  VR
tgtggcgtgcgcgacttcaaattcca

SEQ ID NO: 92 - DNA, 26 bp, Artificial Sequence
  KF
atggaatttgaaaaggcgcacgccac

SEQ ID NO: 93 - DNA, 26 bp, Artificial Sequence
  KR
gtggcgtgcgccttttcaaattccat

SEQ ID NO: 94 - DNA, 27 bp, Artificial Sequence
  RF
atggaatttgaaagagcgcacgccaca

SEQ ID NO: 95 - DNA, 27 bp, Artificial Sequence
  RR
tgtggcgtgcgctctttcaaattccat

SEQ ID NO: 96 - DNA, 27 bp, Artificial Sequence
  FF
atggaatttgaattcgcgcacgccaca

SEQ ID NO: 97 - DNA, 27 bp, Artificial Sequence
  FR
tgtggcgtgcgcgaattcaaattccat

SEQ ID NO: 98 - DNA, 26 bp, Artificial Sequence
  WF
atggaatttgaatgggcgcacgccac

SEQ ID NO: 99 - DNA, 26 bp, Artificial Sequence
  WR
gtggcgtgcgcccattcaaattccat

SEQ ID NO: 100 - DNA, 27 bp, Artificial Sequence
  SF
atggaatttgaaagcgcgcacgccaca

SEQ ID NO: 101 - DNA, 27 bp, Artificial Sequence
  SR
tgtggcgtgcgcgctttcaaattccat

SEQ ID NO: 102 - DNA, 26 bp, Artificial Sequence
  TF
atggaatttgaaacggcgcacgccac

SEQ ID NO: 103 - DNA, 26 bp, Artificial Sequence
  TR
gtggcgtgcgccgtttcaaattccat

SEQ ID NO: 104 - DNA, 27 bp, Artificial Sequence
  NF
atggaatttgaaaacgcgcacgccaca

SEQ ID NO: 105 - DNA, 27 bp, Artificial Sequence
  NR
tgtggcgtgcgcgttttcaaattccat

SEQ ID NO: 106 - DNA, 26 bp, Artificial Sequence
  QF
atggaatttgaacaggcgcacgccac

SEQ ID NO: 107 - DNA, 26 bp, Artificial Sequence
  QR
gtggcgtgcgcctgttcaaattccat

SEQ ID NO: 108 - DNA, 26 bp, Artificial Sequence
  prMErt
atttatacctatccacccaggcttcc

SEQ ID NO: 109 - DNA, 30 bp, Artificial Sequence
  prMEfw
aatctcgagagttgtcatagcttgtgcagg

SEQ ID NO: 110 - DNA, 30 bp, Artificial Sequence
  prMErv
attccgcggtgatgtcaatggcacatccag

SEQ ID NO: 111 - protein, 54 aa, Artificial Sequence
  Majority Sequence in Figure 13
PASTAWRNRELLVEFEEPHATKQSVVALGSQEGALHTALAGAIPVEFSSSVKLT

What is claimed is:

1. A DNA construct comprising a cDNA sequence that encodes a JEV genomic RNA and has a nucleotide sequence set forth in SEQ ID NO:1 or SEQ ID NO:32;
  wherein the DNA construct comprises a nucleotide sequence set forth in SEQ ID NO:2 when the cDNA sequence has the nucleotide sequence set forth in SEQ ID NO:1, and wherein the DNA construct comprises a nucleotide sequence set forth in SEQ ID NO:33 when the cDNA sequence has the nucleotide sequence set forth in SEQ ID NO:32.

2. The DNA construct of claim 1, further comprising a bacterial artificial chromosome.

3. The DNA construct of claim 1, wherein the DNA construct consists of the nucleotide sequence set forth in SEQ ID NO:2 or SEQ ID NO:33.

4. A DNA construct comprising a nucleic acid sequence that encodes a JEV genomic RNA and has at least about 70% identity to a nucleotide sequence as set forth in SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, or SEQ ID NO:17;
  wherein the nucleic acid sequence is the nucleotide sequence as set forth in SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, or SEQ ID NO:17.

5. A vector comprising the DNA construct of claim 1.

* * * * *